United States Patent 10,407,724 (METHODS AND COMPOSITIONS FOR SCREENING AND TREATING DEVELOPMENTAL DISORDERS) - sequence listing, part 27

SEQ ID NO: 622 - DNA, 1080170 bp, Homo sapiens
  misc_feature (268869)..(418868): n is a, c, g, or t
gccagccactcacttcagtaggatctcctgggtctagagaaatagcaaatattcaggagctcatatatatccttggcctcacaaaaatgaaaaattctaaccctcctcatccttctataattctgaacttaaaccagctggagggcaaccctagtcactacctttatattacaagcaagttccagctggttccatcaacaaagatccatttactgttatatggaacaatttaattttctactaaaaactggatttttaacaactataaatggcaaacattacttattgcagaaatctgcaaaatgcaaagactaattttaataaaaattagtctttttaggcactttctgcaaatatacaaaccacaaaagagacattacacattattcagcacccctgctatactaagggaactttgaatatacgtaaatgtaagccaaagactcttttcggaaaacctccacattaaaaaaaaaaaaaaggagggtggttgcaaagcagtgtaaaaagggaaataaggtccctagaagggaatataattactatttcccattaaaagtaaaatataaagtaacattaaaagtaactataaaatagttaaggcataatttgcaggtcaccataacctgctgaaagctattctaaaatattatttcacaccatagcatgatgccagggatttgtttccaaagaatctggtgaacacagcaatggggataaaatagttcataagctgataaatgttggagagagggagtaggagggggttcattatcttattctaacatcatatatgtttgaaattgtctccattaaaatactttaaaaactactagacattattgatgaacaaatttaattttcatatcctaaaaacaaagaaagatgagtaccttccaatcttcgaatttttgctttcacagaaataacagtttcaaaaggtgaaactctcagctcaaaacatgttccagttaatgtttcaatgaagagctccatggtatcacagaaatgaagtctgtagtaaaatggtcccatgttatcatcattgaagaatggaggctcttttctgttatccattactttgacttttctagttcttctaaaatatgtcgcaggcaactgtattccagttctaggcaaaccaggtttgaagattggtaatatatattgttgttcatgttttgagttttgtacctaaaaaaacaagaatttttttaacaagcctatctgaaagttgtatttgtccataaagattttccgttaactgtggcccatatcaatcttccagacggccccagaattcactttagtgcttttaattatgtctaatcctgaacttttcacatttgtctctgaaatcactctcccatctagaccataagattattaagaatacgcatatttttgatattataatgtatcttactagagctcagcacagttatatatatagtacatgctcaacaaatacttttgttgttaagtgatatataagccaaactcaacaaacacatcagtatatttctgtaaggctttgaaaaatttattcatatccttttctaaaacatacaaattatgtcttctataccatataaagcataactttacaacgattgtacatttgactttttttttttttttgacagagtctcgctctgtcgccaggctggagtgcagtggcacaatctcggctcactgcaacctccgcctcccgggttcaagcaattctcctgcctcagcctcccaagaagctgggattacaggcacccaccaccatgcccagcagatttttgtatttttagtagagacggggtttcaccacgttggccaggatggtctcgatctcttcaccttgtgatccacccgcctcggcctcccaaagtgctgggattacaggcgtgagccaccatgcctactcctgttgtatatttgaatcatactggataaaaggaatgccaaccaccataataggttgcttaaaaatagtactcactaggctgggggctgtggctcatgcctgtaatcccagcactttgggaggccgagatggcagatcatgatgaggtcaggagatcgagaccatcctggctaacatggtgagacccaatctctactaaaaatacaagaaaaaaatgagctgggcgtggcggtgtctgcctgtagtcccagctacttgggaggctgaggcaggagaatggcgtgaacccgggaggcagagcttgcggtgagccgagattgcgccacaacaccccagcctgggcaacagagcaagactctggtctcaaaaacaaaaaaaagtagtactcactaaatcatcaacggtttccagaggatattatagcattcagatgacattagaattggtaataagtattagacaatctctgctcacatacatacaatggctaataagtatgagtggtaagcccaacaaatagaagtagtaaactaaatgacaagtatagaactaggagcacaaaaatgatcaaattgctattgctattaatcgtgaaaactctatacaggggggccttgaacttaaactaggacaaatgatacacatctttctggtgaggtggttaaacctttttaaaaatagctttattgagggccaggcacagtggctcacacctgtaatcccagcacgttgggaggccgaggtgggcggatcacctgaggtcaggagttcgagaccagcctggccaaaatggcgaaaccccatctctaccaaaaaatacaaaaattagccaggaatggtggcgcacacctgtagtcccagctactcgggaggctgaggcaggagaaccgcttgagtccaggaggcagaggttgcagtgagccaagattgcaccactgcactccaacctgggtgacagagcaagactccatcattaaataagaaaaaaaaagctttattgaaatataattcacatgccataaaattcactcatttaaagcctaaaattcactggtttttatgatgtacacagagttgtgcaacaatcaccacatttgctttagaaaattttcattacctctaaaaggaaccccataccctgtaaccaacactcccaaattcccccagtcccccactcaaccctaggcaaccactaatctactttctatctccaaattggtctattctggacatttcacataaatagaatcatatatgatttttttgtgactggcttctttcacttagcataatgttttcaaagttcatcatgttctaggatatatcagtatttcactcctttttattgctgaataatagtcccctgtagcaatatatctcatgttgtttatccatccatcagttgatgagcatttgagtcgtttccaattttgggctgttacatatagtgctaagatgaacattcaactgcaagtttttgtgtaaacatatgttttcctttctctttgaagtagctttgctagataatgtggtaactcttatgtttggcaatttgtggaactaccaaactgttttctaaatggtatggatcattttatagtcccatcaacaatgaatgagggtgccaatttctccacacccttgacaatacttgtttctgtccttttgattaaagctatcctagtgggtgtgaagtagtatctcactgtggttgacttccatttctttaaaaactaatgatattgtgcatcttttttatgtgattattggccatttgcatacattctttggagaaatgcctattcatatactttgtctattttttaattggattttttattgagttgtatgagtttttatattacatattctagataaaaacacttaacagatatatgaatggtaaatattttctctcattttgtgggttgtcttttgatagtatcttttgaaacacaaaggtttttaattttgttaaactctaatttggctatttttcttttatcatacttaaaaagcttggcttaacccaaggtaataaagattgacttatatatgtttctaaaaattgtagttttagctcttatgtttaggtgtactgtccaatttcaatttagttttgtgtatggtgtgaggtagagtctaactttattcttttgcatgtggataaccagttgttccagtatcatttgtcagaattaccattcattcccaattgaattgtcttggatccttgttaaaaaccaatttactgtaaatgtgaaggtttatttccagactctttattctgttgatctacctatgccagtaccaccacatcttaattaatgtagctttgtagtaagttctgaaatcaggaagtgtgaggcctccaatttgttctttttagattgttggctattctggactccttgaattgccatatgaattttaagtatgcccattttgcaaaaatgtcagctgggattttgacagggattgtattaagtctgtagatttggagagtactgcaatcttaatactaagtcttctaatccataaatacatactatttttcagtttatatctaatttatttcaatgttttataatttttaaagcacaagttttgttctcttttattaaatttattcctaagtattttattcctttaaatgctattacaaatggaatcactgtcttatttacagattgctcattgctggtttatagaaacacaaccgattttaatatcttgatcctgtacactgcaactgtgctgaactgtttatttcgttcatttagttatttaaatcttcctaaacgctctctataaaagctctatatacaagatcatgtcatttacaaatagagttttacttctccctttctaatctatatgctcttttctttctttttttttttttttttttttttggagggggtgaaagtcccactctgttgcccgggctgaagtgaaatggcacgatctccgcttattgtaacctccgcctcccgagttcaagcgattcgcctgtctcagcttcccaaatagctgggattacaggcacctgccaccacaccaggcaaatttttgtatttttagtagagacaaggttttaccaagttggccaggctggtctcgaactgctgacctcaggtgacccacccaccctggcctcccaaagagctgggattacaggcctgagccactgcactgggcttatttccctttcttgcctaattgccctgctctggaaccttcagtacaagattgaataaaagtggtgagactggacatccttgtctaattcttgattgtagaaggaaaccattgagtctttaggtataatgttaaccgtggggttttcatagattaccaatataaggttgacgagcttcccttctattcctgctttaggtgggttttctttttaatcatgaaggggtgccaattttatcaaacgcttttttcattgtctattgaaataatcatttggttttctttacttttttattcacatattacattactttttatgtgtcaaatcaatcttgcattactggggtaaatcccatttgtacctggtatgtaatcctttacatatgttgatggatttgatctgaaaatatttcctcaggatttctgtgtctataatcacaagagatgatgatctgtagttttcattatgtctgtcaggatttggtatcagggtaatattggccttagccaaactaagcttcgtaagtgaaggagaaataaaatcctttacagacaagcaaatgctgagagattttgtcaccaccaggcctgccttacaagagctcctgaaggaaacactaaacatggaaaggaacaaccggtaccagccactgcaaaaacatgccaaatggtaaagaccattgatgctgtgaagaaactgcaacaattaatgggcaaaataaccagctaacatcataaagacaggatcaaattcacacataacaatattagccttacatgtgagtgggctaaatgccccaattaaaagacattttaatgtctggcaaattcttctcagcaccacatcgcacttattccaaagttgaccacatagctggaagtaaagcactccttagcaaatgtaaaacaacagaaatcacaacaaactgtctctcagaccacagtgcaatcaaattataactcaggattaagaaactcactcaaaactgcacaactacatggaaactgaacaacctgctcctgaatgactactgggtaaataacgaaatgaaggcagaaataaagatgttctttgaaaccaatgagaacaaagacacaacgcaccagaatctctgggacacatttaaagcagtgtgtacagggaaatttatagcactaaatgcccacaagagaaagcaggaaagatctaaaattgacaccctaaaatcacaattaaaagaactagagaagcaagagcaaacaaattcaaaagctagcaggaggcaagaaataactaagatcagagcagaactgaaggaaatagagacacaaaaatcccttcaaaaaatcaatgaatctgagagctggttttttgaaaagatcaacaaaattgatagattgttagtaagactaaagaatcaaatagatgcaataaaaaaagataaaggggatatcaccagcgatcccacagaaatacaaactaccatcagagaataccataaacacctctacacaaataaactggaaaatctagaagaaattgataaattcctggacacatataccttcccaggactaaaccaggaagaagtggaatctctgaagaaaccaataacaggctctgaaattgaggcaataattaatagcctaccaacaaaaaaagtccaggtccagatggattcacagccaaattctaccaggggtacaaagaggagctggtaccattccttctgaaactattccaatcaatagaaaaagagggaatcctccctaactcattttatgaggccagcatcatcctgataccaaagcctggcagacacacaacaaaaaaagagaattttagaccagtatccctgatgaacatctatgcgaaaatcctcaataaaatactggcacaccgaatccagcagcacatcaaaaagcttatccactatgatcaagtcggcctcatccctgggatgcaaggctggttcaatacaggcaaatcaataaatataatccatcacataaacagagccaatgacaaaaaccacatgattatcttaatagatgcagaaaaggcctttgacaaaatccaacagctcttcatgctaaaaactcttaataaactaggtattgatggaacgtatctcaaaataataagagctatttatgacaaactcacagccaatatcatagtgaatgggcaaaaactggaagcattccctttgaaaaccggcacaagacagggatgccctctctcaccactcctatttaacacagtgttggaagttctggccagagcaatcagacaggagacagaaataaaggatattcaattaggaaaagaggaagtcaaattgtccctgtttgcagatgacatgattatacatttagaaaaccccatcgtcccaacccaaaatctccttaagctgataaacaacttaagcaaagtctcagggtacaaaatcaatgtgcaaaaatcacaactatctgattttttttttttttttttgagacggagtttcacttttgttgcccaggctggagtgcaatggtgtgatcttggctcaccacaacctccgcctcccagattcaagtgattctcctgcctcagcctccctagtagctgggattacaggcatgtgccaccacgcccggctaatttttttgcatttttagtagagatttctcccaacaggggtttctccatgttcgtcaggctggtctcaaactctcaacctcaggtgatccgcctgcctcggcctcccaaagtgctgggattacaggcgtaagccactgtgcccagcctacaaccatctttgacaaacctgacaaaaacaagacgtagggaaatgattccctatttaataaatggtgctgggaaaactggctagccatatgtagaaagctgaaactggatcccttccttacaccttatacaaaaattaattcaagatggattaaagacttaaatgttagacctgaaaccataaaaaccctagaagaaaacctaggcaataccattcaggacataggcatgagcacggacttcatgactaaaacaccaaaagcaatggcaacaaaagccaaaatagacaaatgggatctaattaaactaaagagcttctgcacagcaaaagaaactaccatcagagtgaacaggcaacctacagaatgggaaaaaaattttgcaatctacccatctgacagagggctaatatccagaatctacaaagaacttagacaaattttcaagaaaaaaacaaccgcatcaaaaagtgggcaaaggatatgaacagacagttctcaaaagaagatatttatgcagccaacagacacatgaaaaaacactcatcatcactggtcatcagaaaaatgcaaatcaaaaccacagtgagataccatctcacaccagttagaatggcgatcattagaaagttaggaaacaacagatgctggagaggatgtgtagaaataggaacacttttacactgttggtgggactgtaaattagttcaaccgttgtggaaaacagtgtggcaattcctcaaggatctagaactagaaataccatttgacccagcgatcccattactgggtatatacccaaaggattataaatcatgccactataaagacacatgcacacgtatgtttactgtggcacaattcacaacagcaaagacttggaaccaacccaaatgtccatcagtgatagagtggattaagaatatgtggcacatatacaccatggaatactatgcagccataaaaaaaggatgagttcatgtcctttgcatggacatggatgaagctggaaaccatcattctcagcaaactgtcacaaggacagaaaaccaaacaccgccatgttctcactcatagatgggaactcaacaatgagaacacttggacacagggaggggaacatcacacactggggcctgtcgtggggagtgagatggggggagggatagcattaagagaaatacgcaatataaatgacgagttagtcggtgcagaaaaccaacatggcacatgtatagctatgtaccaaacctgcacgttgtgcacatgtaccctagaacttaaaaaaaaaaaaaaaatcaattcccaaagcatttctctcatttcttctgaaaagtttctaaaaacacaactccaaggatgaaatggaagttaaaggtaaacaggcaatagcgctgaatacgtaatttcagtaactcagaattttctccaacctctgctctaaagaagcttagctacagaagagcagttacctttgaaacattttccccaacataaagatatccggaatgtgaagctgccattaaaactgtgacacagatctacatttactgatacatcaaaacatccctaaagttcgaaatacgagctacagaatcacatcaaccgcctaacttgtctgtagcctaaactctagtccggagttcatctgcaagcggaattgggaagtatttcagagccagcatctcctcgcgccatccaggtacctacacacttgaggccaccgagtcacctgcgcagccgttgctcctccaagaccaatccgggctccccagacccaccggcctgaatctggaggacagcagtccgcgtgacaacagcgactcggagatcagcacccgtcgggaaagccgcgtacccgttgaagctggcgtcacgcccaaaggaacaaacgccagagcgtgtgtcctgggcaaaggcggcccgccgctccggtccccgggcagcagcggccggcgtcaggccgcaaggcgaggggcggggacaggactctacccggcagcccagcgccgagcgcccgcgccactccggccttgcgccattccggccccacgacggccggcggcggcagcgcggctgggctcagcggctcgcagcccgggcgccccccctgccggccgctcgctagctcagcctcacccgcagtcttgtccgctggctcgctcgcccgcctacaggtcgacagggcccaacgacccggcgagcaacttcacggaaggcactggccgacaacgctccgctgccgccgcgccccgcccctttgtgacaccacctaccaatcgctggacggcgctttcgctgccctccaatcagcgcgggcgggggcaggcctggcccccggacgtgggcggttgccggggcgccagggccctggggccttcttggcattcgctggaggttgtgagttacgaggcccggatgttgatcttttattactagcaacactggacccctgactcgtgcccacgcgggcgtctggagggcagccgcatggcctgctgggaacggcggggttgaagccggagccgccctccgtgagacccaccggggatcctcttccaggcgcctgatttgctggagataggcgatacaggcagacgctgtccagtcggtggcctctccagagtgaggggcgctcctggtgcgtttgggccggcctgtcctaacaaatctgctttaggcttcaccgtcccctaatgtttctggcctcaattgcctcatctggaaaatgggggcattaccgtgcctgcttgaagacaaaggcgaaaacagataactttctgtagtcctcatacaatttactgagaactgtaggccaggcaatggagtaggcaccctgggctcaaatcccagcgttgggtaagcccagccacacctcctgctccagtttccaagctgctgagctgcggtgtaaacagtaactggcttcaagccaacacctgcctttcaacctaacatgggagcccactgcctcgttccgttccccctaccgattttccaactccgtgaacctccttcactaagtgggttactcagctgacaaagaatgtcatctcactcccactgcgggttcactcatcctcgacttctggctcagaggagccagtctaatatgaaactaaacatctaatctgtgtctcctgtcctctctcattcttctgagaccctacccaccaacttatctccacagttcaacgaactattgagcatacactgggggagtatggtgaggcactgggcattgattcaccagtctcgccgttggttccttctgaaactccacatatgcttaatgctaaatagattggagacctttgaggacagagctatgatggtaatcatctttgcattcctgagcctagaatagggcctgtgatggagacttactgagtaaaaaccttagcgtttctcacccttgcctgcccacttcattcacactggagaattgacagcatggaccgtggagtcaggcaggtgtgtttaaagccttgcctcccaataccagaagctccattacctggccaagtcattcattctttacaacatcatcatcattatcatctgccattcttcaagtgccagatagttgataagggtctttacgtattctctccccatcacaatcctgcaaagttggtagtgaaatccctcgtctacaaaggagtaaacaaaagccaattaaagtagaacaatttacctataatcaaacagctctatgtcggaaagccatatttaaactaggacacaatacaaaaatccaaccttgttccattattccacattgcttccagattttagctttatctgtaaaattagtgttactacattacctatctgatagaccatggagactgaataaaatagcattaaaagttgttaccataggaacttttttttaacgtaagttctctctccctttcaagcctctcaaaatagcagcttgcgtattttctaaacctgttgtctcctgaatcccctgaaaccaatcctactgattgatgagtagatttagttgttccaaaagaaaatcatcgtatttaacaaatgctgactctgaccgacattgggtactacagcaagaaactatgtgcacaaataacctacggacagaaggaagatgcataaaatgaataggggaaaggagtggccaactagcaagtgccctcatctgtcatcacgtcactctcacagcagacttgggcaaatggttgacctgtgggagctgaacaaaatctttgactctgggtatgagtaattccctgtctgatcttacagtgcccaaggaagaagtcagtagctccaggatcgctgagaccaacctgggcggcctacaagactgcaccatggtgacaggctgaatagtcagcagcaagacgacagagcaccaaaaaacacagactagaatggggtcagccatccaggtggctagtggctactgcctttgacgatgcagataaagaaaattttcattcctgcagagttctatggggcagtgctgctctagaggctgacatttctatcctcagcacttcccccggctattacctaggttcattctgctgcttccacaaggcaagaatggaacagaatgccttagagcaatggtcagcgaactgtttatgtaaaggggcagggccaggcgcagtggctcacgcctgttatccccgcactttgggaggccgaggcaggtggatcacgaggtcaggagttcaagaccaacctggccaacatggtgaaaccccaactctactaaaaatacaaaaattagctgggtgtgatggcaggcgcctgtaatcccagctactcgggaggctgaggcaggagcatcgcttcaacccaggaaatagaggttgcagtgagccaagatcacatgactgcactccagcctgggtgacagagcaagactccgtctcaaaaaaataaataaaaggggcagatagaaaacatctgaggctctgtgagccatccggtctcgtcataattactcaactcttacattggaggtagggtgaaagcaacaatagaaagtaagtaaatcaatgaatgtggttgtgttccaataaaactttattaacaagatcagacagtgggggggggggggtagcatagtttgccaaacgaaaatccaataaaaatttattaaagatttaaatgtggccaagcgtggtggctcatgactgtaatcccagcactttgggaagcggaggcgggtggatcacaaggtcaggaggtcgagaacatcctggccaacatggcaaaaccctgtctctactaaaagcacaaaaattagctgggcgtggtagcgcgtgcctatagtcccagctactcaggaggctaaggcaggagaatcacttgaacccgggaggcgaaggctgcagtgagtcgagatcgcaccactgcactccagcctgggcaacagagcgagactctgtctccaaaaaaaaaaaaatcaaaaaacaacatttaagtgtaagacctgaaatgagaaaacttttcttttaggtttttgtctagaagtttctaggtattgatcttgacaataatttacagaatatgtcacaaaagtggagacatgaaaagccaaactaaacatgggacaatgccaaattgaaaaccttcacagcaaagaaaccaatgaacaaattaaaaagctttttaacaattatccaaaatacctaaagaacttgtattaataaataggaaaaaaaactgaaacaaaacagaaaagcatcaaaaagcttaaaaataagcagatttggccgggcacggtggctcatgcctgtaatcccagcactttaggaggccgaggtggacggataacctgaggtcgggagttcgagaccagcctgaccaacatggagaaaccctatctctactaaaaatacaaaattagccgggcatggtggcacatacctgtaatcccagctactagggaggctgaggcagaagaatctcttgagcccgggaggcggaggttgtggtgagccaagatcatgccaccagtctgggcaacaagagctaaactccgtctcaaaaaaaaaaaaaaaaaaacatgttcagcaaggttgaagcatcaaaggttaatagccagaatcatttatcaattgtatttctacacatctgcaagacacaatctgaaaatgaaattagaaaaacaacttcattgggcaacaagagcaaaacttcatctcaaaaaaaaagaaaaaaaaaatagtaatctacaatgtcatttcctgttcaagcttgacttctacctttactttctgatatggttttgccatgtccccccacccacatctcatcatgaattataatccccataatcctgatgtgtcgagggaggggcctagggggaggtgattggatcacgggggcagttatcctcatgctgttcttgtgatattcagtaagtcctcatgagatcttatagggttttgttttgttttgttttttggatggagtcttgctctgtcacccagactgcagtaccatggcgcgatcttggctcactgcagcctctgcctcctgggttccagtgattctcctgcctcagcctcctgagtagctgggattacgggcatgcgccaccacacccagctaatttttgtatttttagtagagacgggatttcactaagttagctaggctggtctcgaactcctgacctcagttgatccacctgctttggcctcccaaagtaccagggttacaagtgtgagccaccaagcccagctgagatctgatggttttacacatgtttgacagttgctccttcacatgttcccactctctgtgcggccaccatgtaagtcggacctggttccccttctgccatgattgtaagtttcctgaagcctacccagccatgcgaaactgtgaatcaattaaacctgtttcctttataaattatccaacctcaggtatttctttatatcagtgtgaaacagactaatgtgctttccgataatcatgcttcaggaattggggaattcagactacctgggatcaaattgtggccccaaccttagcagccatgtgaccttggggaggttacttaccttctccatctcaactccttcagtaaaatctgtaaaatgacattgtttctgagggttaaatgagcatagcacagtgtcaggcacacactacttgccagatgtcgagtattcatctttattgaaataggactgtggtaagccactttatggctctcgattttgtatgagaaaatcatgcttagtgccttgttagtaaaagaaagaaaacctgaaagtccctgccacggaaggaagaaatagcggggagaaaagggagttggtaagtttcagcatttcagagcttggagagggacaagttaggtttccattttatggagaaggaggtggaggcaggatgggtcctaaggtgtcattcaaaacacacagccataactctttattgagagtagcgctagggccccagggattgctgtggtcaagttgcggacaaaaatgaccactcgttggaagacaggagaggagtgtttagttacaaaagcagtcaacaattcaggtgtatctatattcagacagcaaataaaagttgttcaacttggttgctaatgggacccactctactgaggctttgtatagaactcatagaggaagatggcttcaaggaatgaactaccctgtgcttttcttaggactaaaatctcaggaagctggtgatgaatgaaaaccttagtcccactggcactgcacgaggggccaggagagcagcagcatcataagccgcagggtggggcagccaaggcaggggcattctgagctgttggggaggggtggcaggcagggtggggcactgtgagctgtcggggagggcattgtgaagtgtggggtggggcattgtgtgccacatgcctgggctcccacctggggccagtgggcttcagtctgtaggtgactacagaaggaggaggagctccgtctgttctctcttcaggcagttgttgtgtctctcagcacttgttgggttcacaacctattaaataagccggctggtcttcaccctcccagacaagtcaactcaggggaggcagcagggtgcgggccttggccagggccagggccagggccagggccagggctggtgcccggggccgcgctgtgaggtgggcaggcgaggagcgggaagaccatctctgcaagtgcagcatagcctcggcctaggacagcgggagtgcgtggccaaagctgtgagcagaggcacaggtggtggcagacagtagaggcaccccatggggaacatactgacctgtcgtgtgcaccctagcgtcagcctcgagtttgaccagcaacaggggtcggtgtgtccctctgaatctgagatctatgaggcagtagctggggacaggatggcaggagcgcccatggctgctgctgtgcagcctgctgaggtgactgttgaagttggtgaggacctccacatgcaccacgttcgtgaccgggagatgcctgaaggtaaggaggtgataggtgccatctaccctcggtttgcctctggctgctgctgtccccaaggttccctttgaggcatcccccactttgagctcctttctgcttgtagccagcttttccgggggctggccaggaacaaaagctggctctgccttgaattcccaccccttagtctttccccaccaagtccagtcagtttcttttcgcctcccctcccaatcgcccagttcttgctctctcacctcattctcccaggctggcatgggaccatttatttatggctcttgtcgaataagcagcagttgaataaatgagttgataaatttttataaatgattacatcttttttcttttctccctctatacatatagctttggagtttaacctttctgccaatccagaggcaagcacaatattccagaggaactctcaaacagatggtgagacaacagtgtctgtagctctgtttattatcctgtgggactttgtttaggcttctttgagctattctcttccttttctcaataaaaactcaaatatcccaacttttcagtacccatcttattttttctttgtacctatccagatggtacctaagtgaaggaaccaggtaagtgcctaattgtttcctttgttaaagtagtcaaatctcaggacagttcctattcaaatatttggggatttcttatttaaaatcagaatggagtttgccacgggagaggctatatggtattcttaatgggctgctttaagtcaccttgatagaagctgcttagtttcttctaactgtaatttgaacacagaaggaaaaagaaaaaaggagagtgcttaaaataattgtgaaaggtgtgaaatgtcacagccggggctgcagaaaaatggttgtgtgtgtgtgtttggggtttctcaaaggagtttacctatgaggctctgattactttaaaattcttactttaacagaaaatgtgtctccagatttattctggtgacttaacagactttatttacctccttgttctaaaagagaggtggggattggttcatggtcaaaactttcaaaagacatgaaacgtcaatgtagactttcaatgtgtaatataaagattgcaggttaaaatgtcagaccttccctgtaagagtgtttgttgccatggctccccctttgtcccttcccctcctgacaatagcatcttgttcaaagataagaaagttacagttttggctgggcttggtggctcacgcctgtaatcccagcactttgggaggccgtggcaggcggatcacctgaggtcaggagttccagaccagcctggccaacatggtgaaacgctgtctctactaaaaaaaaaatacaaaaattagctgggcgtagtggcacatgactgtagttccagctactcacaaggctgaggcaggagaattgcttggacctgggaggtggaggttgcagtgagcagagatcacgccaatgcactccagcctgggtgacagagcgagactccgtctcacaaaaaaaaaaaaggaaagaaagttggagttttttagtctctacactgctggcagaggcaggggatgggagccggtagaaaagagaaaacaattagttggtttgcctctaaaattttgcaaagagatgaatctaagtaaaagtaattctgggtaataatatggttcttgaataaaaactgaaattttcaaaatagaaaacattgcatcataaacatattacatccagtaggcttattggtttcatttaaatgccagagatttcatcactgtagaggaaatgtcttatagctcttctatttaaactttggttgcgctcttaatttttaaagaggtaggataattaagactcattatgagtgtgactttgtaacttggaagtactatcttcacatttcaagatatttaaggattgctttagaataaacaaatgtattatgtgaattaattgattgtacctttatacacaaagcatgtaagtacttgtgtaaacttatactctgcttggtgatgttcggaaagcctgatggatgttacacaccagttagtagatgggtagtgttggatgagagcccaaaaatggctctttattgtcattctttaggattacaacacagtttatgtatgtctcacttggccctttccaatacaaataaggcctgtgtatgttctccctatgtgttgctaatgaagaaatgaaaacttagagatatcacatgactatggaagacagctactcaagagaactaaggttctgtgtcctcagaatgaaatggaagtgacagatatgatgaatttactttttaaaaattttaaaaactctagaatacctcttatattttgcctataaaatagacctgtcttttaaaacttactgccatcttgatttattttatgcaaagttgattttacacaactcaaagccaaaatttacctcttcttttttttttttttttaaataaaggagggtgtcattatgttactcatgctggcctcaacttcctgacctgggttcaagtgattttcccatctcagcctcctgagtagctgggactacaagcatgtgccatcttgcctggctctgtcttgtgtctatacgctcatttcaatggataagaatcaaagtagagatagtgaaatagcctaaatgcagcagccgaataaacgagttgataaatttttatcaatgattacatctttttttcttttcttcctctatgcatatagctttggagtttaacccttctgccaatccagaggcaagcacaatattccagaggaactctcaaacagatggtgagacgacattgttttttccgccaagagaaagaataaaagctcttgtttgatcaggttatagaaagtatttagaaaaactcatattggtttaaaattttcatcttttcacatgttcccttgtcttattttaatatgtgatatactttcctttagttgttatgatgttagtgaaaacgtgtaacctttttgtttatacattttgccatctttttatcaacacaattaatttgtgatgtgatggaggagtcatggatttctctttataattcttggatttatctttatttataattaatggatttatctttatttataatcccttttcccttgctccaaaaagtacattttaaagatgaatgatagaacttaggcttcagcttggttttcatttaaacaaattaaaaaacgtagttgtttatcatcagggattgaatctgtgatttgggcctcctcttacacagtcctctgaccacattcatttaccacatccaagttcatgctactcaaaagttttaggttattaactttttcatttgatataatgtaaatttaaacatgccttactcctgcttatttcccttaatgttatgttaaatcctcatttatttgccaacaagccatacacagccaagttttccagttgacttaaacagcaagaacacaagtgagggttctataataatgtgcgaagtaatgcagcacagtaaaacacgggagtttgtaacctttgtttttatagtttgagtagactttgcccatcttgagtcagttatttctggttagaatttgtcttcattttttacattactataaagagatacctaaggctgggtgatttataacaaaaagaggtttaattggctcaaagattttcaggctgtacaaacatggctttaacatctgcttctggtgagggcctcagcaaacttacaatcatgataaaaggcaaaggggaagcaggtggttccacaccgtgaaagagggaggagagaggggaagggggaaggtaccacactctttttttttttttttttgaaatggagtctcactctgttgcccaggctggagtgcaatggcacgatcttggctcactacaacctccatctcccaggttcaagcaattctcctgcctcagcctcccgagtagttgggactatagttgggcaccataacacctagctaatttctgtatttttggtagagacagggtttcaccatgttggccaggctggtctgaaactcctgacctcaagtgatctacccgcttcagcctcccaaagtgctgggattacaggcttcagccaccgcacctggccagtaccacagtcttttaaattaccataatgagaatgtgcttattaccatggggatgggaccaagccattcataaggaatccactgccattacccaaacgcctcccactaggccctgtctccaacattaagggtcacatgttaacatgagacttggaggggcaacatatccaaaacatatcagaattgtatttcccagttccttccagaggcatgggcttctcacacctagagagcatggaagcagtaaaagaaaagctattccatgtccctcactcttcagtggtagtaacttttgcctacaaggccctcccagcatcaaaggcagaggcagtgtaggaaacaaagcatggcccaagtccctcttggggcttttattattctggcctctttttagggaaaaaaaaatgattttttgtgctgcagacaccatgtccaattaggtttgtatacttattttaacatcaaaatttaggccaggctctgtggcttacacctgtaatcccaactctttgggaggttgaggtgggtggatcacgaggttaggagatcaagaccatcctggttaacacagtgtaactctgtctctactaaaaatacaaaaaacaattagctaggcatggtggcacgtgcctgtggtcccagctagtccggaggctaaggctgaagaattgcttgaacctgggaggcagaggttgcagtgcgctgagatcccgccactgcactcgagcctaggtgacagagtgagactccatctcaaaaaagaaaacaaatttaagataggttactttccagttgtgtaaagaccattttttaattttgttttgtttttagtgacatattagtagataaccactaagtgtggttcaagatgcttacagggtttctgttgcatctagagataggtgtctggtcaggaagtagtttttagaactgttagctcttagagtctgataattaaagtaagctatgtgtaaatgcagaatgagagaatactaatggatcatggctcatatatgcaacagttaaactttttattagctaaatttttcatctggcctaatttttttgcccttttcttttgtacatgaggattctttcatttgtatgtaatagaaacaaaaagtaaactaaatgaaaatctaagtttttagatttgacttatgaaattaatcatgccagataatttaaattatatgttattgaaaattttttttaatggaattttgtctcatttttcataggagtaatcagtaagatgttaacaactacttttattttatggtatttgtatcagaagtgaccagtttttttttttttattcttagttgtagaaataagaagaagcaactgtacaaaccatgtaagtaaacactcaaatagttaagaaattgatagtttgacataaatggatgtctctcttgatttctttaaattacaatgtggacctggtggtggtagcatggacctctttttgtggattttctaaatctcttctattttcctgagtattaaatttatccaggaaagtgcttagtttagcgtgtccaccttttaaagatttctgacatttaagttaaatttcaatagtccggttcaaaagatctgccttaaggctgggcatggtggctaatgtctgtaatcacaacactttaggaggccgaggcaggctgatcatctgaggtcaggagtttgagacaaccctgaccaacatggtgaaattctgtatctactaaaaatacaaaagtagctgggcgtggtggtgcatgcctgtaatctcagctactcaggaggctgaggcaggagaatcacttgaacccaggaggcggaggttgcagtgagccaagatcgcgccattgcactccagcctggacgacagagcgaaactctgtctcaaaaaaaaaaaaaaaattgccttaaatatttaatcttatttttaatgaaagaacaaaaatagaatagctaagttaattgccagcactgtctattgactttctgtcacagcaggtaaaagcataccttccccgctacaccatgatcttatgtttctccctgtgttttttccaattgtagcacactttttaattaaatcagtaatatttacatgattatgactctgcaaatattattcactgctaagtcatatggtgttttcactgtgcctctgcattccatgtccttcatcctgtctctgaaacagttctgaaatctgagcacttctgcaattctcctggatcttcttttttcctagcctacgttagtttatctatccaaatatcgttaagtagcctctgggtgctctgtttgctttcacatccattattttttagcatgaagctaattttctgactatattcatttgcctgttttctaacagctgttttcccccaagtattgtagcatttatcacatgcctttcaaagatattttccatctgcgaaaacacatctgttcctttttatgtttgtgtggggggcaactttctttggccttttgtcatcctagttcaatatagcgtgggtttccctagatatgctcaatgtctgcttttctgggctaactctttaaagtcttttggtatctcacgtaactgctgtcttgtgtgggatcgcctgagtcctagattctgtgtttccttctgtcctgttatcgtctctagttgtacttgaacacattttcctgtgtggagatgttaaaatccctcctctttgatagagagtacacctctaggttgaatctaaatgttgtggttctgaagacattttgcagttgtgctcttattacagtgttgttcttgaatctattgccagtgtgtgatacgttatttacaaccaggttttagttatctgcggaagctttttggaatctctctctctaaggttctgaaattttataacagcttgttggggatcttttcattttattgaggctactaaacctgcagactatctcttcttgagaatttttttttattttctctgttacttttttactgatagtcttgttattcagatgctaggctgcttagaccaatacgcctgcattgatttttaattttttcccttgtatttttttcagtttgtctttttattctagttctgggatattctgtgactttatcctctactatttctattgaattttatattttttgagagtgttttaagatttttttttaaagttttgctcctgattttgactggtcctatcaattccttttttctattgttttgatctcttttcttggaggcttccctccaatgtgtggtggtccctggcctgctttatttggaagcaggatttctgttaactgatagcactcagtgtgaggccttagaagcctgactagcttttcatttgggagacctcagtgtattatctggggatctttattgaagacatttcagtttcttctgagaaggatctcccaattttctgcctggaaagtaaaagcaggcctggaaaggaaaagcagagttagcgaagaaagttggagttccatttttggtgtacagttttctttatatctcaggtttaagccatggtatctctgagccagaaattctcaggtttgatatatccagagaacacacatctaagtttcttgtcagatggaaggacaggtggacttggggctctagttagagatttgcaactgaacttgctggctttttttttttttttcacattttaccctactttccaaagtgccatttgcctgtaagttcacaacctgcctttagttctgcaagacaaactggctcgcttctgttccagtcactttctgtaggcaccaaagttgtgtttctgtgttatttaccactcctttatctactttttatgtctcagcatttattagaaattatctctgtcaaccttctgtgctggtcatgggtgtaacctttattttatgactgatgaggcttccggagggagacgaaataaatttgtggtcaatctattatatttaatccaaatttaggacctgtgtttaaatcaaagtctaatttgagtataattaatgatattaagccagagaattttttaaattaatgtatctataataagcatattacacttttctcctaaggccttgtttaatattttcattcaaagtttatccactgccatatacttcccattacttcacaacatagatggagctgttttcctgaatgcccaaaatgttagaaatatttaagttaattaagatttgttcatttttagcctggtcaacatagcaagacctcatgtctacaaaaaggttaaataaaaaattagccaggcctggtggcatgcacctttcgtattacctactcaggaggttgaggcagaggatcgcttgagctcaggagtttgaggctgcagttaactataattgcaccactgcactccagcctgggcaacaaagggagaccctgtctcggaaaaaggaaaaaagttactaattctttaaaaacctatctaaaatttgtcctgcccaaaaggagagtgaaaaatatgaactttagtctttgttttattttatgtttgctgagaaaaatgctgtactttatttatttatttattatttccataggtttctgggggaacaggtggcatttggtgacatgactaagttctttagtgatgatttgtgagatttaggtgcacccatcacctgagcagtatccgctgaacccaatttgtagtcttttatccctcaccctcctcccagcctttccccgaagtccccaaagtccattgtatcattcttatggctttgcatcctcatagctcagctcccacgtatgaaagagaacatgatatttggttttccatgctgagttatttcacttagaataatagtcttacttccatccaggttgctgggaatgccatgaattcattccttattatggctgaggtggtattcctcatatatatatatatgtatgtatatcacggtttctttatccactcattgattgacgggcatttgggctggttccatatttttgtaattgtaatttgtttgagttcctcatagattctggataatagccctttgtcagatgtatagactgtgaagatttcctcccactctgtggttgtctgtatactctgctgattgttccttttcctgtgcagaagctctttagttaagtctcacctatttgtttctgttgcatttgcttttgtgttcttggtcatgaagtctttgcctaagccagcgtctagatgggtttttccaatgttatcttctagaacttttatggtttcaggtcatagatttatgtccttgatccatcttgagttgatttttgtgtaagctgagagttgaggatccagtttcattctcccacatgtggcttgccaattatcccagcaccatttgttgaatagggtttactttcttcactttatgttttaggtggctttgttgaaaatcagttggctataggtatttgagtttatttctgggttctctattctgttccattggtgtatgtgcctatttttatatcagtaccatgctattttggcgactatggccttatagtatagtttgaaatcaggtaatgtcatgcctccagatttgttgtttttgcttagttttgttttggctatgccggttcttgtttggtccatataaatttcaggattgttttttctagttctgtgaagaaggatggtggtattttgatgggagttgcattgaatttgtagattgcttttggcagtatggtcattttcacaatattcattctacccattcatgagcatggggtgtctttccatttgtttgtgtccatgacttcattcagcaacgttttgtagttcccaacggcatatcaaaaaataatcgggccaggcacagtggctcacacctgtaatcccagcactttgggacgctgaggcggacggatcatgaggtcaggagttcgagaccagcctggccaacatggtgaaatcccatctctactaaaaatacaaaagttagccgggtgtggtggcgctcacctgtaatcccatctactcaggtggctgaggcaggagaatcgcttgaacctcggaggcagaggttgcagtgagccaagatcaccgcactgcatattccagcctgggcaacagagcgagactccatctcaaaaaaaaaaaaaaagataatccaccatgatcaaatgggtttcataccagggatgcagggatggattaacatacacaagtcaataaatgtgatacaccacataaacagaattaaaaacaaaaaatcacatgatcatctaaacagatgcagaaaaagcatttgacaaaatgcagcatccttttatgattaaaaccctcagcaaaatcagcatacaagggtcacagctcaatataataaaagccatctatgacaaacccacaaccaacatgatactgaaagggggaaaagttgaaagcattccccccgagaactggaacaagacaaggatgcccactctcaccacttgtattcaacatactactggaaggcctagccagagcaatcacacaagagaaaacaataaaaggcatgcagatcagtaaagaggaagtcaaactgttgctgtttgatgatgatatgatcatatacctaggaaaccctaaagactcctccaaaaagctcctagaactgataaatgaattcagcaaagtttcaggagacaaaattaatgtacacaaatcagtagcgctgttataccccagaagagaccaagcttagaatcaaaccaagaactcaaccccttttctgatagctgcaaaactaaactaaactaaaataaaatacttgggaatagacctaaccaaggaggtgaaagatgtctacaaggaaaacaactttagtatttttaatgggttaaaatgagaggcagcaggtacagcagaagaagtcagtgcgtgggcatccgcatccaatgggtactgcacctttgatggtaaggctttggttttgacttactaaattactaggtacgattattttctagtttttgtcattaaaccttaaaactactaagtaaccccttccatttcttgttaaatattgtaaaatttcatactctcatttatgctgcctgatgttagagtatttgtttctattttgtgactaccttaaataatacctataaagagtaaactgttagtagtgtttttgctgtaattaaatgtagtaagacttaccttccaaatgataactgaattgtcaaacacttgtcgaagttttggatttactcaaaattctatgctcagcagctggaggtaggaagagtaagggccctcccttactcttatggagaggcatactttctcacaaggggaatactctgcaggaattagcatcttgtaagcagtggtgaattcaactaattagtgtataaaaatacattttttggtgtggctgccgacaaagagatccaagagggtagatggagtcgagcttgctgaagcaaggaaagagaaaagcagtattctaggcagagagcaggggtagagcaggaaaatggctaggtgcaggtcagatgatttatagaatgcaattgatcaagttttgaagtgaatgcaaagtattctccgagagtctcatttgagtcatgtcttggcagtcttatttaaacatgaagtgaaagttagattttttaagttgtcatttgttttcagggtgtgagagaatatgtaagtgatactctttttatcctccacataagaaaataggactagagaaacctatggcttcctcacttgttggtggcctagcagccctggcacacagagcctctgaatctgaaacacttcttttgtaacaatatcacctgaaataatacatttaggattagtaatttagtaaatgcattagtcttgtattcactgcaataaaatgctcttgtagcaggattatttaatacattacattttattgtagtaaataaataatagaagggctgggcgccatggctcacgcctgtaatcccagtactttgggaggctgaggcaggcagatcgcgaggtgaggagatcgaggccatcctggctaacacggtgaaaccccgtctctactaaaaatacaaaaagttagccgggcacggtggtgggcgcctgtagtcccagctactcaggaggctgagtcaggagaatggcgtgaacccgggaggcggagcttgcagtgagccgagatcgcgccactgcactccagcttgggcgacagagcgagactccgtctcaaaaataaataaataaattaattaattaatagaaattctcagctgctttttattgctgcagaaaaaaaatgaaatcttattttaaacttttctttttttttttttttttttttttttttttgagacggagtctcactttgtctgccggcctggagtgcagtggcgcgaactcggctcactgcaagctccgcctcctgggttcaccccattctcctgtttcagcctctcaagtagctgggactacaggggcctgctaccacgcccggctaattttttgtatttttagtaaagacggggtttcaccatgttagccaggatggtctcgatctcttgacctcgtgatccgcccgcctccacctcccaaagtgctaggattacaggtgtgagccaccgcgccccgcgaagccgacttttcccattatttttaacggtaattcataaaatccttgttaggtttgatgacaggtaccatattaagggcagcattttataacccatatcttaaacatcatctctggaagttgagagcctccaatgggttttctatagagtgcacatgataccacactcaggcagttcatggagtgtaagacatatcttagtgctttgtcatttgacattttaactgagaaaataatacactttgataagtttgacttacacttcccttccccttcaggtatctactgtgcgtttcagtcaacaatacagcttgtgttcgacaatattccttgatgacagcacagccatcagcattatcttacaatgacaataatatcgtgagtacaactatgctgccgagggacagattcctttattctaaaattatttcagtcatttggttgtccttttcagcaatcagtttaagaaattggagtcaaccatatattgatatccagattctgaatattaagtatcagtttctcttttaatcttagacgtcgtggtggaaggaaaaatcagttagcaaagaagcaatcccagaaacagtgtatctttttgatgcctttatgcctttagacaatgttgaacagagtgagaaggataggttccctttattgaatgttttcttgtggaaacttagtttttcaatgcatcataggcctaaatcagtgtgcactactttggacattatccttggaagaaggaacagcttttcttcttctggcaacgcagtgtatctgcatttgaatttctcccattgtgcatgagcacctcatgggccacaaagatgcgctttgagagcaccctgagatgaagtttattttaaaaggaacaacaaccaacaccaccaccagctccacaggggctgtccagtgtacattattctcatcttcttgggttattagtcttgatttttagaacacagtttggaaagtgctaatttagaatattaatgtctttatctttaatttaacttttcattctgtacacataactagcttataaacaattttgtttcaaatgcactagcctttttaactaattcaattgtcaataacttttacttcaattaaaagtggaaagtttacactcataataatgtcactttcctccctcccttttaacaatagttgagaggaaattgtgtttcgaacaaaaactggactcaaactctgtctcaagtcctgagctttgggacctattgagtaatcactaaatgtctgtagtcagctaagtctcttaaatctctgagcacacatacacaaaaattactttgactagagtccctggcttcttctgagttccaaagattttcatatgttagcatataattcaaaagcagctttgaagattaattttgctgaaacaaatttcgtgcttttttcctcattattctactttttagaagtctacttttgagagtatagtaagttttaatttgccaccagcaaatttgagaaatgatcatttggtgtattcactattggtgaaataaagttattgaacaaattaattgggcaaattggcttcaagaagatattttgaaaaatgttttatcatgaatcagtagtgcactgttgtcagtgggataggtggaactcgctgagatcacttatgcaaggtttttttcaaaacacaagtctgcaaacacatgtatcttcccatctccactttccctctatctctaggcactgagaagccttttaggaaaatcgggatggatgtgaggcatctttctgtgaagaaaagcatcccagaagattctgattttcaccccaactcaatcattccaaactttgctgctgattgaaatcacctgggaaacgtttaccaagaaccttgatgcccaaagccatacccaatactaattaaattaaaatgtctcatgtggaagatgaggcagatattaaagcttctcaggcgattttaatgtgcagcaaagtttgacagccactgcttaatttgagtttaggatgagaaactgctcctatttggtgggaccttgggcaagtcagttttaaggtctgtttccctgatctgtaaaacgagtgttgaattaaatgtcacataaggtcattggtcctttccagcatgtaactttaaattctgtgattttaaaattatttcagagatgaaaactacttgaagcactatagacatatccatcttacctgctaatgttacaggctttttaaaaagtgctaatattgtgtagacctattagtagaattgagatttgccttccctcagttgttttgaggctcactctacaaaattagctgggtgtggtggcacatgcctgtaatcccagccacttgggaggctgaggcaggagaatctcttgaacccgggaggcagaggttgtggtgagccgagatcacaccattgcactccagcctgggcaacaagagcgaaactccacccaccgcccccctccaaaaaaaaattatctgggcatagtgacacaaacttgtagtcccagcttcttgggaggctgaggcatgagaatcgcttgaacctgggtggtggaggttgtgaggagtcaagatggcaccactgcagtccagtctgagcaagagagacagactctgggtcaaaaaataaataaatacataaaataaatcgcatgggacgaaaggtttcgtgggtagaaaagcatgtaacaaggaaatctgttattatttatatattgtaatcaccaacagaaacgcgtcttctaacggcatatttccttgcattttggttctcatatttttgtaaaaaacaaagaaatgaaaacaaagtgcccttatggtactgttctgaactagaagatttgaatttcagggccactaggagagtttcctctgccccccttttaaaaaatgtcttcaggcctaacaaatgttaacatctattgttatgaattttttttccttccacagtgtgaccttggagatacctcatcatatcacacaaaggtgagctttttagaaacctgtcttgttattctagctaagtactttgcaagatatcaagctcagtgttaggcacatcataagctgtattgtgcctactaaaatattgaagcaaattatttgtattttctttgttccttaagactctcataattcttaaatgattgagaatctcaaagagtatgtgtttatattgattatattgatatttagtgtggtagaattatacaattgaaattttttcaaaatctatttttagtttagatttcacagccttaccactgttgatattatgggctagataatgctttgttgtgaggactgtcttgtgcattgcagagagtttagcagtattcatggcctctaccaactagatatcagtagtaacccatgacccaggttataacaacagaaaatattccttgagaacagtattgttaacagaattttttcattgaaaaataacttttctacaacaaaaagttgagtaaaaagtgcgtcatgtatttatattatttaaagtctctcatgttgagcttaataggagacaaatggattctctagagctttctttgcaatttgctttaaagcagcaataagaggttgggcacggtgtctcacgcctgtaatcccagcactttgggaggctgaggcgggcggatcacaaggtcaggagatcgagaccatcctggctaacacagcgaaaccccgtctctactaaaaatacaaaaacttggctgggcatgatggcacacacctgtagtcccacctattctggaggctgaggcaggagaaccgcttgaacttgggaggcggaggttgcagagagctgagatggtgctattgcactgcagcctgggtgacagagcaagactctgcctaaacaaacaaacaaaaaaagcaataagctggtggggcgcagtggttcacacctgtaatcccagcattttgggaggccgaggtgggtggatcacttgaggtcaggagtttgagaccagcccgaccaacatggtaaaacccgcctctactgaaagtacaaaaaatggctgggcgtggtggtgcatgcctgtagtcccagttacttgggaggctgaggcaggagaatcgcttgagcctgggaggtggaggttgcagtgagccgagatctcgccattgcaccccagcctgggtgacagagagagactctgtctcaaaaaaagaaaaaaagaagcaataagatgaccgaacctcatgcaaatatgtagttggtagaaggtgtatttttaaacttttcagacagttgtgggtatttgttaacactaaatcaaaacttcacaagtggtggtttcttaaattagttacggtggcattttacatattaataaatttattccatcagtactcattgatctttcttccacagtaaatggatcttttgctccatacttgcatttataatatcatgcattagttacttggaatatatcggtttatgttttattgtgtcaaaaatcacttttagtttaaccaccaatcttactttaacacgcctttaagtattgaatagctgccaagcctacagtagaaggaacaagtttttcaaagtccacaggaaagcttaaattttatcattgggaacaaatacgtatttcccttgaagtgacaacctctcacttcatttatttttgagaatgatagttgaactggttttttagaccgagtttcactctgtcacttggctggagtgcattggcatgatctcagctcaagcaatcctctcacctcaggctcctttgtagctggcaccacagatgtgtggcaccacgccaggctaattttcttatatgtttgacagtgacagggtttcgttatgttgcctaggctggtctcgaactcctgaaggagctcaagccatctgcctgctttggtctctcaaagtgctgggattttacaggcgtgagccactgcgctggcccagttgtacttttaaataaaaatgatgttctgtgaaaaaagtgatttttcagttcatagttaaatcacggattctttaaaaacaaaaaaaaaagcgcttctggttaactttccacttattcagaatattagagacatgtcaagatttaacaacattaatttttactgcttcatcaaagacattcttaagaaattcaggctatgttttttacctgtaggggacagtgaagaatagaatgactactaatgtaattggtaccactgccttgatttatgctgagaaaccagccattgtacccacttttgcttttatataatcatggcaagtgtcaacgaaagagcaggcaatggctttgtattactttcacaaatttttaaaatttttcatcagctttctcaggtttaattagtatgattcagaacagtgttggccaggcacagtggctcaggcctgtaatcccagcactttgggaggccgaggcaagcggatcacctgaggttaggagttcaagaccagcctggccaacatggtgaaaccacatctctactaaaaatacaaaacttagccaggagtggtggcaggtgcctgtaatccctgctacttgggaggctggggtaggagaatcacttgaacctgggaggcgaaggttgccatgagccgagatcacaccattgcactccagcctgggcaacaagagtaaaacttggtctcaaaaaaaaaaaaaaaaaagaacagttatgacctcttaggccttctggaaggggtcttcgggatcccgagaggtccacacagcacatttggagaaccactggtttatacacaggcacaatgcattagttttacaaagtttaaagttcatcaaagactggcgtcttaaaaaggcagatgagtttgtcattcaaacaacagaaagtacataaatacatcatgagagtatactacagagaactaaagagaaaggaagctaggaaatctgaatcacatttacatttattaaagtttactactactgctttgtagaacattcttgtgtttcaatgtgtggttagaagagtgaaaatatgtttggtttattgccatggcctgttagggagagtcaatactcacgggcatttctgactggttatcatataaaagacttcacggtacaggccatgatgtgctgagaaagaagaagtcaggaaaccctctgcaagtcaggatccaggagaagaattcgtaaaaactgctttggtaaacaccaaagcacacaggaggcagtattttactaaacaaatattatactaagatattaacagtttttgaagtaacgcgctttcttattttatagagatgcagatagatctttgagcatacctgatgaacagttacactcatttgcggtaagtggcacttttattgaggttgtattttcatcgtacacttgtatctgtttcatgctgaagtcaaagccatctttttttaaatcttccccatttcatgttgcatttagtcatcttaagtgttgtaaaaagaatgtgctggagtaagaactgatctgcagctctgtttagttagtgagctagtatgagtaaatatactatccaaacaacagaaaatgtatctttttttttttttttttttttttttatggactctctttctgtagcccaggctggagtgcaatcgcgcgatcttggctcactgcaggctctgcctcccaggtccctgttcaagcaattctcctgcctcagcctcttgagtaactggaattacaggcatgtgccaccatgcccagctaatttttttttctttttttttttttgtaaagacagggtttcaccatgttggccaggatggtcttgaactcctgacctcgtgatccacccacgttggcctcccaaagtgctgtgattacaggtgtgagccaccatgcctggcccagaaaatgtatctttttaaaaggtaattgtgagctgtctataggaccctgcaagccactacccaatttttgaagccattcctccttctgttccacacaggtttccaccgtgcacattacgaagaacagaaatggaggtgggagtttaaataactattcctcctccattccatcgactcccagcaccagccaggaggaccctcagttcagtgttcctcccactgccaacacacccacccccgtttgcaagcggtccatgcgctggtccaacctgtttacatctgagaaagggagtgacccagacaaagagaggaaagccccggagaatcatgctgacaccatcgggagcggcagagccatccccattaaacagggcatgctcttaaagcgaagtgggaaatggctgaagacatggaaaaagaaatacgtcaccctgtgttccaatggcgtgctcacctattattcaagcttaggtgattatatgaagaatattcataaaaaagagattgaccttcagacatctaccatcaaagtcccaggaaagtggccatccctagccacatcggcctgcgcacccatctccagctctaaaagcaatgacctatccaaggacatggacaccgggctgggtgactccatatgcttcagccccagtatctccagcaccaccggccccaagctcaacccgcccccctctcctcatgccaataaaaagaaacacctaaagaagaaaagcaccaacaactttatgattgtgtctgccactggccaaacgtggcactttgaagccacgacatatgaggagcgggatgcctgggtccaagccatccagagccagatcctggccagcctgcagtcatgcgagagcagtaaaagcaagtcccagctgaccagccagagcgaggccatggccctgcagtcgatccaaaacatgcgtgggaacgcccactgtgtggactgtgagacccagaatcctaagtgggccagtttgaacttgggagtcctcatgtgtattgaatgctcaggtatccaccgcagtcttggcacccgcctttcccgtgtgcgatctctggagctggatgactggccagttgagctcaggaaggttatgtcatctattggcaatgacctagccaacagcatctgggaagggagcagccagggacagacaaaaccctcagaaaagtccacgagggaagaaaaggaacggtggatcctttccaaatatgaggagaagctctttctggccccactaccctgcactgatctgtccctgggccagcagctgctgcgggccaccgctgatgaggacctgcagacagccatcctgctgctggcacatggctcccgtgaggaggtgaacgagacctgtggggagggagacggctgcacggcgctccatctggcctgccgcaaggggaatgtggtcctggcgcagctcctgatctggtacggggtggacgtcatggcccgagatgcccacgggaacacagcgctgacctacgcccggcaggcctccagccaggagtgcatcaacgtgcttctgcagtacggctgccccgacgagtgcgtgtagttctgttttatttgactacagtctccttggtgcaaaaacaaaatgggaaaaataaggataactcagaatttcaaaaggaaatcacaaattcagcttataatagcattttcagtacttctcataaactaagtaaatacacaaaatgttgatttttctgaccataagacatattttatgtccttttgccgaggtggatgtgttagtctcaggccctcctggccacattgcccaagtcacacaggcttctgtattatgtatttagataagatgtgtgaaaatatatttgaaaaaaagttcataaatttgcattgatttttgtacacatggcacctctttttcattttttttttttttttggacgatgttttgctctgtggccccagctggagttcagtggcgtgatatctgctcactgcaagctctgcctcccggattcacaccattctcctgcctcagcctctcaggtagctgggactacaggtgcctgccaccacacctggctaattttttgtatttttagtagagacatggtttcaccatgttagccaggatggtctcgaactcctgaccttgtgatccacctgcctcggcctcccaaagtgttgggattacaggcgtgagccaccgtgcccggtccgtggcacctctcttaatttataaattgaactgaatgtgaagtaataatgtcagctagttgagataagagggttacagatcggctgggcgcagtggcccacacctgtaatcctagcactttgggaggcctaggcggactgatcaccaggtcaggagattgagaccatcctggctaacatcatgaaaccccatctctactaaaaaatacaaaaaattagctgggcatggccgggcgtggtggctcacacctgtaatcccaccactttgggaggccgaggcaggcggatcacaaggtcaggagatcaagaccatcctggctaacatggtgaaaccccgtctctgctaaaaatacaaaaaaaaaaaaattagccaggtgtggtggcgggcacctgtagtcccagctacttgggaggctgaggcaggagaatggcgtgaacccaggaggcggagcttgcaatgagctgagattgcaccactgcactccagcctgggtgaccaagcgagactccatctcaaaaaaaaaaaaattagctgggcatggtggcgggcacctgtagtcccagctacttgggaggctgaggcaggagaatggcatgaactcaggaggcaaagcttgcagtgagcagagattgtgccactgcactccagcctgggcaacagagcgagactcggtctcaaaaaaaagaaaagaaaaagagggttacagatcattgcacatggaaaatattcccagcagtaaacacttccattaatgtgatctacagcttttaaaaaggagcatctcagaataagatggtggtacaatttgcttattgagaaaggaaaaaaaaatacatgagtatattacaaagggaaaagaaggaatgtgatttctcatgattgaaagcttgatttagattgcatacagcttttgctacccaagaccaagcagctctggcaagacagggtggttttccgaatgccagaccgaggtgccttatgaaggcagctgccgatggttccagatgtagagagataggtgatgcaggagggaaagctggattggaaaagggagagttttgtagacgggctatgctcattgtgcctttgaaagagcagagctggcagcctgtagtcatcatttggatatacaggactagagcatgaatctgatgtagagctacagaatgaagagcaacagcagctgtttaaataccgagaaagtgtgtagaatgaaattggacgagccaagcatggtggtttcatgcctttagtcctagctactttggaggctgaggtggggaattacttgagctcagcagtttgagtccagcctgggccagatggtgagaccctgtatcttaagaaaagaagaaataagaccaggtacagtaagtatctcatgcctgtaatcccagcactttgggaggccaagttgagaggactgctcgagtgtaggacttcaagaccagactgggcaataaagtgagacccatttctaccaaaaaaaaatcaagaaattagctggacatggtggcacatgcctgtggccccagttacatggcatggcaggctgaggcaggaagatcacttgagcccaggaggtggaggctgcagtgacccatattcatgccactgcactccagcctaggcaacagagtgagaccctctctcaaaaacagataaagtggacagaaaataggtcggtaaggactaatcatttaagggacaagcccccagaagagtggctactagagtgggaggaggaaaagcagaaggagaaagagttgaagataggcgaggctgtggtcccagtgctgaattctgccaagcagtgacttgattcatgaacactcactggatgctgactctgttgctcttctgagtgctggggtagaggagaggagaggtggagcacagttcttgcttttatgagcttatgttctaggaagttcaaacaagtattttttcaggtagtatgaaatagcaggaagaggaagcaggctaaagggacacagagtgattgggggctattttaagtagaatgataaggaagagcctgtctagagagctatttgaacagtgacctgactgaagggacaacagaaagcagtgctgacattacaggtagcaggatgactgccaagacagaaacgcatttcatatgtgttcgaggaacaaacagcaaggtgaccagcatggggagagtgaagaatgagggaaaccttgaatgagaataaagcaattccatcttggatgctaatctgcaatattctgattaatcccagttccaacaattcatctacgatttctattttatctttttaaaaaaattattttttattttttattttttgagaccgagtctcactctgtctcccaggttggacttcagtggcacaatctcagctcactgcaaacttcacctcctgggttcaagcgattctcctgcctcagcttcccgagtaactgggattacaggcgcctgccaccacgcctggctaatttttgtatttttagtagagacgaggttttaccgtgttggccaggctggtctggaactcctgacctcaggtgatccgcccaccttggcctcccaaagagctgggattgcaggcgtgagccaccgtgtctggccatacacatccctgctgaagcccgcattacccttcccctatgctatagaagccctgggtcgggggggtgggggtgatggcacagggatccaccatcttatcttggtgccatccctgacttgccttctgttcataaacgcctattaaatgtttctttctgagaaactggatttgtcagcctctttctttggtatctcaggttccttggcctttgcgggtaggtttatatagacctgctcagcacaggacaggcagtttctcaaaaaattgaaaatagaattaccaaatgatccggcaatatcacttctgggtatatagccaaaataattgaaagcaaggtctcatagaaatatgtgtacactgatatttatagcagtggtattcacactcgtcaaaagatggatgcagccgaattgtccataggcagatgaattgataaaatgtggtatatacatacagtaaaatattcttcagccttaaaaaggaaggaaattctaacacatgctacaacatggatgaacattgaggacattatgctaagtgaaataagccagttagaaaaagacaaatactgtgttctttcacttatgtgaagcgtccagactgagtaagcaaactaatagaaacagaaggtagaacgggggttgccagggacatggggaagggagaaaatgggaagttgcttagtggatatagagttttggttttgtcagatgagaaagttccggagattggttgcatggcaatgtgaatatactctacattacccaacccaagggctctccttgacccctgttccaactgccacttagaagtggttaaggtagtaaattttatgtatattttaccacaattcaaaatagaattattattattttttttattataattttttgagatccctcactctgttgcccaggctggagtgcaatggcaccatctcggctcactgcaacctctgccttctgggttcaagcgattctcctgcctcagcctcccaagtagctggaacttacaggcacatgccaccatgccaaactaatttttgtatgtttagtagagacagggtttcaccatgtttgccaggctggtctcgaactcctgacctcaggtgatccacctgccttggcctcccaaagtgctgggattacaggtgtaagccaccatgcccagctgtcaaaatagtttttttttgtttttttttttgtttttttttttttttttgagatggagttttgcttttgttggccaggctggagtgcaatggcaggatctcggctcatggcaacctccacctcccgtgttcaagcaattctactgcctcagcctcccgagtagctgggattacaggcatgcaccaccatgcccagctaattttgtattttattttagtatagatggggtttctccatgttggtcaggctggtctccaactcctgacctcaggtgatccacccacctcggcctcccaaagtgctgggattacaggtgtgagccattgtgcctggccttttttttttttttttttttttgtgatggaccttcgctcttgttatccaggctggagtgcaatggcacgatctcagctcactgcagcctctcctcctgggttcaagcgattctctttcatcagcctcctgagtagctgggattacaggcatgcaccaccacgcctggctaattttgtatttttagtaggtatggggtttctccatgttgatcaggctggttttgaactcctgacctcaggtgatccacccgcctcggcttcccaaagtgttaggattacaggcgtgagccactgcgcctggcctgaaaaaaaatttaaaagtttgagaaaatataaaatttttatagtctccatgtatttctcctaagatctttccccctatgaggggaggaaagaggaattattataacacaggaagatgtttaatactcaggattttttatatcatcatatttaaagtctttttctgcacagctaaatctgattccctgctactaaatctgattgagttagcaactaaactaactgatttggtagtatctatccagatcacaaacagaaatattgttaagactccctcaaaaaggagtttaacctcaataggtaactcctcctaactatagttctaaattaatgaaacacagtagtcatttaacaagatactagtatatatggccattggggtatatgggacatgctacctcaaaatatgacaccttggcatttgagaaaacagaagcagaaaggtctctctgacctttccctggcccttctcctctgaagcaggacatagaagaatcctctaaccctctctggagtaggtcataagaacttaattccagtcctccctattcccagaggaaaggagcctccttatttgtaaagatgcagagaatgatctgaccacacaggccttgctgagctcccccagcttattcccttcaggtcacacccctttcatctaatcgtgcttctccaaaactgtccgcttcttcatcagacagcatccaattgacacaggatttcctgtttctcttgagtttttctttctgaaggctcctgtgtctggtaaaacttatcttacgtaaacttgcacacttttctctggttaatctgtcatttgttctaagggactcgaccatgaacctagcgatggctgagaaatcatttcccccctagccggcctaactcatttgaaggagcatacactattgtgtgggagtcatacttattcctaaccattttgaagagattcatctttaaattaatatattacattaaatgtcttccttcagaaaagacaatcttgtgaacatcgcctttggtgactgaacatcacgagatataaaacaggtagaaaaagaaaatatttggggtggctctaactcttaaatcccatgaaataatcccctcttctttagcagaaacctcagctcacctcctcatcactgctgaacaacagggcagatgctttctttttggagagcttggaggcttttgctttctcttgtctttgagcttgtagagacaatgtctgcttcttagcagctgtacccccaaaaagattatcctagaaaagcaaatggcagaaaggtaagacaactttataatcagaaaacataggatgtcctcctatatcaaactttaaggaagtaagtctccagtcaggtatacaaataacaactctggtgaggaaaaaccacaaaatgctagtaaatcccaaactacagccttttctcactgcacccatagaagggaaagagattaccatagaactcgaaggcagaacagctgtgaataagcaggagaacaacatgcgaatgagatcatgaagtacaaggagaaactgagccccatccagtcgccctgtgggcaagtgcctctctgctcatttcaggtggttacagcctgcgatgggcacgggagcccccgcagcagccagaaactcacactgttgtctccacaaatgagaaaccagaacaatggctgaaaggagagaactgggggtctgtctccactcctttacaggtcagaaagacatacacctgggatggagggaaggcatgacttgtgtttctcattagtttcaaagagattatacaaagtggagaaatagcttactaaataaaattgctggtgtactaagtttaatggcatttgtaaattcttctgtggtcaagcactccccaaaagttatatttattaaggtgcttttattcagataaggggaacaaaagcatcagagggcctgagtctgagttaggatggacaaactcttaacagcaggtgaacagccctggaatgtgaagatggatgaagggagtgtcttcctggatgaagtctcctttaaggagagtgcggtaatgtaggacaggccaggagaataatgagctggtgtccattggggatgctaatgacagagctcacattcactatgcacttattatgtgccggcactctgcatgagcttcacactagtagttacagctgccacaatgaccctactcactgttaagccacatgagcttaaggaaggttaagttacttgccccaggttcctggtttgcaagtggtggagctgggatatgaacccaggggtctgatggcaaagcctctgagctcaccaccgcccagtactgcatgagagttaaggtttgggttgtcttctctcttatttctcttccccactgtgctctctccagccaggatgggaaagaaagacaatggtcaggacatggctgccttctcctttgtatctccacttgatccaaaacattcttgtaggtcattgggtatatgttgatccatcctctagactaaagtacagctcaccctgaatgacacaggtttgagctgcacaggtccacttctacacaaatgttttctcagtaatatgctgaaaattttttttggcatttgcaacaatttgaaaaatcttgcagacaaaccacttagcctagaaatatcaaaaaaaaataaggaaatgctagatatgtcaggaatacaaaaatatataaatagatactatactatttataggttaatcaactgtttgtgttacccatgaggcttctggttaacagtaaggtatcagtagataagtttttgggaagtaagaagttatatatggatttttcactgcaatgtggaagccaaaacaacctcctcactgttaaagggtcaattgtatttctcaaaggaagatttctaaaaataaaacctgtagatttcactccataagaactgtgtcaagaggccaggcacggtggctcgtacctgtaatcctagcacctagggaggccgaggcaggcagatcaactgagatcaggaatttgagactagcctggccaacatgatgaaaccctgtctctactaacaatacaaaaattagccgggagtggtggtgcacgcctgtagtctcacctacttgggaggttgaggtagaagaatctcttgaacccggttgcagtgagccaagattgcaccactgcactccagactgggtgacagagaaagactccatctcaaaaaaaaaaaaaaaaaaaaaaaagaactgcgtcaagaatctaatgtcttctccattgcacagctaggaaaatataaggaagaagtcactgaaataaaaacagaaatatttttgttatataaacttcaggtagcctgactgcttccctaccaccttttgctagtatatgagcctctgggtagaaagttacatcaacaaccgttttctcctaatctaaattatctagtgttacaataacaatgtttacctcttcatcttcatcatcaaacagggaaaccgacgtggggagcttgccaggcagcagagacgcaccttttaagttactcgcactttgagaagaaaacaaatcctgttggattgaaattaaaaagttgctggttaacaggaatatcagtttttaaaatatcaggtcagtataaaacacaagtgactcagacatgacagctgccatgtgtctaggcttctttcctgagagggaaggtggctcagacagagtccttaaaggaggcctcagggtctgtgcagggtgtgtgcagtggcgctaaggaggaggagagctacaggatctggtgggctcgcagagcccaggggcttctgtattcccacctgaatgacagaaggcaggaataagtttttgaatcaatttcctacaccatgctaaaaaaataaataaataagaatggcttcccattactgtctaaagaatcagaaattagacagggtcaataaagaaataggagctagattcccaaattaagggacctacaactattttatttcgtaacacccttctttcctaagattatgacttatttctttttcttttttctttctttttttttttgagatggagtctcactttgtcacccaggctggagtgcagtggcgccatgttggctcactgcaagctctgcctcccggattcacaccattctcctgcctcagcctcctgagtagctgggactacaggcgcccgccaccacgcccggctaatttttttatatttttagtagagaccgggtttccccgtgttagccaggatggtctcgatctcctgacctcgtgatccgcccgcctctgcctcccaaagtgctgggattacagacctgagccaccgcgcccagcccacttatttcttttaaataaatacaaattaaatttttatttgtaaatgtttgatagtctacttagttttactacaagtatatgatgttgcaaaccaggataagacctgctagattctgaataaactttcagcctggcactgtggctcatacctataatcccagcattttgggaggctggggcaggtggatcacctgaggtcaggagttcgagaccagcctgggcaacatgacaaaaccctgtctctactaaaaatacaaaattagccaggcgtggaggtgggtgcctgtaatctcagctactcaggaggctgaggcaggagaattgcttgaacccggaaggcggaggttgcagtgagccgagatcccaccattgcactgcagcctgggcaaaaagagtgaaattttgtctcaaaaaagtaaaaaatataaaaataaagaaattttcaaaacgttataagacatcagcttatcctgcaaagaaagacctacaaattgagctacatgaagtagaaacataaaatgggacatctaatcccttgggaagagaaacattaatacacaagagctgaacaattaaataggacaagaacatattttctaagacctcttctgacagtttttttttttttaatcatggggttgatgtctactcctcaaacatagacctaatgagttcactaagtgagatctcctccacacagtgtttttcccctgtgctccccggagtcccatgggtttatttagatagaagaggccacaaggggaattccaggcatcccgtgtccctcctgcatgttacacaatggcaagagaaagggttctgctgttctaagaaaatgaaagtaaaccaaagcaaagaacaaaaacaaatgtcaacatcacagttttggacccttaactaatacttttattggtactgcaaaaaaagacacttccattacctcaaatatgttcccctaaaatgacttcacagggcaagcttcagccccacacttgagatacagagaaaggagtcaggacgcattcctttgggtccaaagctttaactcttacttagactgccttagttttacttctccttgcctcagaatctgaacaatatccaataaaaacattcactctatgatgacacacatgaggcaaagcctttggtagggttttcacacaagtctgagagtacatttacactcccaccatcaagaaggggagcctatggcccctccccatgaacctggatgggccattgtgaccatcttgaccaacaaatgaagcaaaaggaccaccgttgacttccaaggctggaacacagaaggcaacatggcctccactgggctctctctgaggactctcccctacagccctgagccagcatgtaagaggaccggcttccctgactacatgctgggagccacacagggctagtgagagatgtcccaggggccccagtgcccaggtaccagacatatgagtgagctgaccctcagcccagccaccttcagacacaagagaccctcagtgacaacggcctagctaagcccagtcaaactctcgaagtatgagataacaaaactactggtgttataaactactaggttttggagttacttgtttcatagcaacaaataaccagaacatctcgtaagtcactgaaattgctcacatttggttttcttgtctaatcaacaattactggatggcttaccacatgccaagcactggtattaaggacagggtgctggggatacaaacagggaataaaaagtcctgtccttgtggcacttactttagtgggaagtagagacaatgaataagtaaatatacattgtccctggcaacacgtgctgtggtaaacagtgaaataggaaagaggaccaggagcacagcgtggtatgtgctagcaggcttcctgttgtgtgtatttcatcagcgaggcctcacagagaaatcgaagagtgaggaagaaagctggattctgggaacagcattcctcagagtggcaggggccggtgcaaagaccccgaggtgcaggtgtgggtgacacaggggatccatgagcataagacggtggaggccccatcatgctgtttctcaggggtcagggttgtgacttgactggactttggttaattgccatgttttgtacactcgccttcaatgaaataatagcctcaaaggtattctttacgtcaagggcaatcactatacttccaaagggttccatgttcatccttgctgtgagtgcaaagcccaaccatgacagcctaacctagagcccacagtttcttgaaatacatgtaagtttctgccatgtccacatgtttttctgtaaaaggggcttattatttcccattacatttctcatacaggtctccgatctcctaaaaggccaacttaaaattagatctaagacgacctaggcctgagagattcaggaaaagcagtgaaattctgagaggtggttctaaggtacctggagggaccaaagcaacctgtgaaccagggtcccacaggctgttagtggtctcagtctcgacaagacagatggctatgccagaacccatctgctacagcattaagccacggtctagttagtgagaatgtgaataaaggaagtagcatggtgacctccactctggtgcaagctcctcatcacatcatgagcccatgaacagtttacaatctgagcatcctaaaaagagagtattttcatcccaggaaacgtaaatacagtccaacccaaaagtgaaaagtattgtaaacatattgctttctaaaacccctgtgctctcaagagattattttttattcatttatttattttgagacgaagtctcactctgtcgcccaggctggagtgcaatggcgtgatctcggttcattgcaacttctgcctcccgggttcaagtgaatctcctatctcagcctcctgagtaattgggattacaggctcgcaccaccatgcccagctaatttttgtctttttaatagagacagggtttcatcatgttggccagcctggtcttgaactcctgacctcaggtgtccacctgccttggactcccaaagtgctgggattacaggcatgaaccaccgctcctgacctctagagataatttttaaagaactggagtacttaacgaaaagtcttataactctgctgagaaaaacctgattcagaaatagtttctatgtcatatccatagactaatacccacaactaaggaaaagaataccatacctcagagtcctcctgatcctaaaataagcctttttgagtgtttgtttctgacgagggcttgagatttttgctggaaggtaaggtaacctttgttgggggaaaagaaaagaaaaagaaaaattaagcattaacaaataagatacccagaaaagagtgtttactcaatcaaccatttagaaaatgcacggagtctctgctgtgataggcagcaagccgagggggctgttaggagaacagcaagacaaacagaggacacatctggtgtatcagggagcaggacacacagtctgggtcaatgggtgcacagatgggacatatgcaatgagagacagcatggaaagacaggctgcctgacaggcctaccaggttctgaatgctgggccttagggggtcggcaggagaaagtcagggtttcacagccaggacatgacatgatgagacaaactgtagaaagaggagggaccagctgtacaggacagcagtgaaaggtcaagcagtcaaaagggcttaaaaactgctggggacacacacactggccaaatgcaggtcaatctgagcaccaaaaactatgatggtctggccaacatggtcaaacccagtctctacaaaaaaatacaaaaattagctaggcatggtggtgtgcacatatagtcccagctacttggtaggctgaggctggagaatcgcttgagcccagggggttgaggctgcagtgagctgtgattgcaccactatactccagcctgggcaatagagcaagaccctgtctcagaaaaaaaaggaagaagaggaatgatggtaatggattatcatctacactgaagaatgaattcatgatcccaaagcaacactaaaaattagggaagcagaggacgaggaaactctttattcagaagataccaactaataagaaatatagaattaaaaaagcagtggtttatgaccactaacaggttaactgattcaggaaaagatcatcagtggattttcaaaacactgagtaaaaggctgggagagaacaggtattcacactgttcagctatcactttagagatcaacttagcaatggcaaaagagaacagggtacctttccaatgaagcagtgtggtgggcaccctaacaaccaagtgacaaacgtgtctgaatgaggcagacagtggacctgatgtatcttgggaggtgatccaactggaagtgcacaaccctgcctgcttgtattcttgccaaaactgctcaccctgaatcaattcatagaaaaataatcaagcaaattcatgcgacacattctacaagacaagtggctggacgttaaaaaaaaaaaaaaaaaagatgtgggaggtgttgcactagattaaggagaccaaagagacaggacaaccaaatgcaatgcagacatactgcctgaatcctgggtttcttaaaacaaaacaaaaaaaatcaaaatacacaaaaatactataaagcaggggtccccaaccctgggctgcagaccagtccatgacctgttaggagccaggccgcacagcaggaggtgaggtgagcagcaagcattactgcctgagctcctcctcctgtcagatcagtggcagcatcagattctcataggagggcaaacgctattgtgaactgtacatgcgagggatctaggttgcaagttgcactctcctaatgtccccaatgccaaaaaggttggggaccgctgctataaatggcattttggggacaagagaggaaattacaatataaactatatgtgagataattttaaatctgtattctatttgttggggtgattttacaaagacattctgggacaactggagcaattctaatacagactagatattagattctactatagaattactgttagtctcacagctgttgataatggcattgtgcttatatggaagtcttttcaagagaggcttaatgaaatatttaggggtagaatgtcacaatgactacatggaaacagttccatgcagcaaacagttcaaacaacttacatgcaaatagttcaggaaaaaaatagatatgtaacaaggtttacatccataaagtgtttgccaaaaccctaagaactgatcaatctgggtggcagttatttgggtgttcactgcaatgttctttccactttctgtttgaagttcttcaatatgaacgtgaaagggaacagtacttccctctgggttccggatgaattattaaaatgctgcagatcaatgctcctgcgttaagtcctccctcctgctcgcctttttttctgctcttgctttattttcatctgtctgactcaccgtggcttctggcgatgctacggctttttctttgaacagatctccttcttcatcaccaaagatatcagcagtggattggactttgcctttaaataccaaggcataaaattacaataaggccggaaatcctaccacaaaaaatcctaccacaaaattcatagaataaaaaattcttccctcccgaagattaatatgaaagttacattgtttcttggttacttataaagaaatagtaagtggaactatactcttcccttcaaatttttcaaagagtgtattgacagctcagttgaaagacagaacaaatagtttaaccatgcagctgacatgcttatccaagcagcagtctcctgctgcggttagagaagcttggactaacttaaaaggtgaagagggatctagaggaagaaagatcacttaagaggaacaccaagtcaatcatctaaggaatctgagaaatgaaggctgggctcctgctttaaaaaaatcaaactgggctgggcacagtggctcacacctgtaatcccagcactttgggaggccaaggcgggtggatcacgtgaggtcaggagtttgagaccacactggccaacgtggtgaaaccccatctctactaaaaatgcaaaaattagctgggtgtggggcaggcgcctgtaatcccagctactcgggaggctgaggtaggagaattggttgaacccaggagacggaggttgcagtgagccgagatccgccactgcactccaccctgggtgacagagcaagactccatctcaaaaaaaaaaaaaaaaaaaaaaaaatcaaactgtacaaaagcagataaaagcaaataatgaaattccctcataattccacctgcctactcgaacaacatggacattggaaacagttcagcatacatgcttccaattcccccaaaggatgtactaatgagttaacactagttatttacaaataaggctataaataagaaggtaatttgaacaatgtgtcttaccatttgtattttccacttaatgtacctataaaaccttcccaagtcaacaagcgtagaccccactcgttttaacagtcgcacaatattccactgaatagaagggccatcgcttactctactgatgaatattttcaccacagtaaacactgctgtaccgaatggggcatgcgttgctgaaatgaggtcactgactcatgaatgtctgaagagactaggagttgtcaaagaaagcagcatcaatttactagtgattctaaatcagttctcaaagatatccactaagtgagagccctgtggagctacaaaaagcactactaccttcattcactgtcatcttcaccgagacctgcatgcattctgcatccgtttgcactctttctagattaactaggctatcgttttccctcgtgctttggcttccatccttactttctacacctaacactggaaaaggacagtaagtccagacagtctgcttctaaatgcattctgattccatctattcctatatcatccttttttattttttaaagttgctgaaaatcatgtgcaacttagggatctagggatctacctttcttttctggaagagcagtcaatggatctaagtcttgctattccaagtgtgatctacagaccatgaagcttgctggaaatgtaaattctcaggccccaccctggacctactgaatcggaatcttcattttgacaaaagcctctgggagattcatctgcgcatttaaaaacaaatgatttacaggaatgacttcaggaacacaggacttacatttaagaggaaaaagaaaggagaatgccaaaaagaaaggagtggccaagtggatgaaaaccccatcatgtgaagaaagaccaaggccacctgagctttttggcagagagaagagaagctgggaactaaacggccagcacacaaaatgctgctcatgtaattgactaaggtcagctggaagaaagtatgattaaaactttataattccaaaggtcagaactgcgaattaagcaaaaattatagggataaagacttcagctctctataaggaaaataatcatagtaattagcttacagagcagaaaagattgggtcataaaacagacctcccaggcaccacacctacgtaagtacagacacaacagctcaatgacaggaatgctggggaagggattctggtactataagagatacagaactaggtgagcttatcttccatttaggcaacattctttttctggctgaagtcctagacacagaggcaggaacaaatacctgttttggaaggtttgctgtggggtgtcgagaaaaagtcgttatcatcatcaccatcatcatcatcaaacaggccagtgggagggggaccataggggcttttccttggagtgggctgctcaggcttctgtggctccttcagtgatggaacggaggcagcacatccgtgtctcctgtgagtgaagggacaagacagacacagctgtgagccagtgtgggcctgttgaatttacagaaaaaaattatcacccaccaaaaactttccatttcagttaatccacaaaatgcattaacagggcccaatagcctccatccattactgctacagaacatctcacaatggagaatcaccaggtcactcaaacacaaaaaagtccaaggccactgagctctaggagaataagagctaatatcagtaaatgagctctttctatacgctgctcaaagccctttgaagctcccaggtacttcctcatctccagccaggctttagaagatgataattttgaaatggaaaaaacagtatttgtgtagtttttagaaaacaaacctgttatgttacctaaaaatacagaaacagctcctgctaggattttctttccaggtttggatgatgaagactctagaatgagaaagcaagggataaccatttttacaagggaaataactttccttgctattttcttcctgaaatatgtgcaatgtaacacacagctagtaccagaccttttgaaactactttttcctgaacaagccattttaaaattctttagtattttcttctctactgacatcaggacttttttggggggattgatacaatctcagctgtgactccaatggaagagcatgctgaccgtcatcaagccacagcagtgggtcagctgggggacaccaagggaggaggtgagcacagctggcagaggcagggacagcatgaccggggctcccccaaacagttccacctctacccattccagttggatgagaatgaacgagtgaaaaagaacagcaaaaacatgtgagtcatcagtaaaaaaataaagacataagagcaaagggggaaaccaagcaagtcactgatgccaaaacgtggacagcagaatgcagaggagcccgcacagcacgcacaaggagcggcttccaaggcccagctctgatgcctgtgcccgggagactcggcacttagaatcactaattcccaagtcccaagaactaccacaaacctatggagtaacatttgtaggttaaaaaacatatttatatttgtgttttttaaaaactgcaccaatgggacaggtgcagtggctcatgcctgtattcctagcattttgccaggtctaggcgggtgatcacttgaggataggagtttaagaccagcctgtccaaccgtcgtccaacacggtgaaaccctgtctctactaaaaatacaaaaacaaaaacaaaaacaaaacctgtgcagatgattttaatgcacactgggttggggaattactggtctccaacttatatacagaatgttaaaaacgtttctttaaattaaacttcattcaatgaaaatcatcctcaacattgctctagggtacttttcttgtctgactttttatgagttctctcctaacaaagaggcaagactgtggtatgggtttaccggtggtactgttttttccaagacatgaattagtgaagatgaattactttcaactggaccgcagtaaaaacaacagcttcctgcttaacacagaaacaaggcttgggaacaacctcagggttccatctcctagtgagaaagacagttttggaactctgcacacggagacgcagctgcccagccccagcttaccctccttaacagaggctccagcttgccgatcctggggggcttccgtgaagaggtcactctggttgaaataaggtatatgacaaagaattcaaaaaaccaggagaaagcatagctgcatgtgaggattcctaaggaaaaataacctacaagatttaaagctacatatttactactctgccagaaaatcagttgcaaagtgataactatggcaaaatcagaccctaaaataatttaggcctgtccaggaattaaaaacaaacgtggaagacaacagataaggcaagaaacaatcacctagtaaattattcacattaacacgtgcacatcttctcctcacctaacaaagcacagaaggatacggcatttctcactctgtgattcttagttcaaaatgtcccaaaatatgaaaatagaagcaacttccaactgagaaactgttttttccccactaaacaagcaaagcctatttcttccctgtggacccctgacacagctagctgcagggagtgttgctgagtgccatggactcacctcctcgtcctcatcatcaaagagccccttgcccccactgaacaggccacctccagagccaaatggcgagaagtcctcgtcggtcagcttggggggtgcgaataagttatcctcttcatctagcaaacagaaagcaatgttttgcaaggagtattaaagacgggtccggaactcaaattcctgggttggcgtctgcaatgtctccaaactggcatgaagtttatctgaccctctttatcgaagtgtgaggcagtctgacgaatttcacactaaccccctggcacagtccactgacaccctcaaaagactctctgggcctccactctcaagtctgtccatgtctgcggcagacagcattcattctctaggccagcaccctggatctagatttactctgaagcaagcattcaggtcagatgccacattcaagacccattccccaaccaatctgggggaaggaagggcagaataaacaaagggacctgcagactgacacagggacaagtggaatgtaatggacatggctgtttaataggaaaaggcctggtgtatcctttattgaaaacaaatgctagagatccctaagtttctatatttctaaagaattctagaaagacaagaaatgattgctgtaaaatctaataaatcaaatctctacaggaatttttactccacacccacatatcctcccagcaccccaaaacatgccttccaaggcttttgtttgtttgtttttgagatggagtcttgcactgtcacccatgctggaatgcagtggcgcgatcaaggctcactgcaacctctgcctcccgggttcaagtgattctcctgcctcagcctcccaagtagctggtactacaggcacccgccaccatgccaagctaatttattgtattttagtagaaatggggtttcactatgttggccaggctggtcttaaactcctgatcttatgatccgcccacctcggcctcccaaagcgctgggattacaggcgggagccaccacgcccagcccagaggctttagaaaagtaaatggagacagacccatttgtcagaaggaaaacagcatgtaaagcagtacttcatgaattatgtaagcaacattcccgagtcaaagcctcctaaaataacagaattgagggaaaaggcccaccgtccgaaggagttctcctttccttcttctcttgagtgtcttccgaagttttgcttctcctgagggtaaggcttgaagaacagttcacagttttaatagtactaagtcctccctcagtatacgcatcctggttctttccacgtctgtcatcctcataactcacagctaagagcaagacatctgcctttcatctcagctgcactgaaccccctgccctgcccacagtgggcactcaagagtctctttgtaaggcagaaggcttctgctttcatcccaggctcatgtgcataacaggattgtatttgttgaaagaattattatgttatctttctactctcttataactagaatatgctatatagcacattcttacgtgttcaaaatataggagtaaatattcagccaggaattcttaagctgttgcccatggttctctggagtttccattagtcccctgaaattatatgtaaagggttatctacatgtgtacatgtacgtttttcttgtgggtccacagtgttcagttatctaaaggagctcattaaccaaaaaaggaataagcactacaatttaaattatatgtagcaattactaataaatatatgtggtaattactaataaaaagagaaatccgcctttggtgaagccagcagagggccctgcactacccctcccctactccccatcaacgcggctggggctcacttgtcggctcctcgtccactcggcccacggcatcccccttgatgcgggcagccagctcatctgcaaacgatgtaggtctgcttcttttctacagcaggagaaatcaaaagaatcgcttttttgtaacaaactagtacacttcactttggacacctaacaacattatgtatacaagagcaaagaaattgaactgaggagaaaactgagtttaattaaatgaacttaaacatatgtaccctatacagctcacccaaggaatgggactcaaaatgttccttcaaagggagatgctctttatttccttatttttttaatacttgactttaatacttaaaaatctaaataagaaaataagaaaaaggtcatgggcagggagacaggagcactatggtcttcaaactctggaaccagacatattctgaatgatctgactcataaaatcataacatctggacaagaaagtggtacttgtgaggcaatttgagatgcttgccattattttccaaagtgtagatgaaatgacaaatatgcaaaaatgagagatgtacaaagtaagtcacaataaaaaataaaaaaagtcattggttctaaaaccctgccaagtgatagcaactacagccttccttacaggtctagtattttcttcaatgtcctcaatatctttctcctccttctcagagtcagcaaaaaggtcacagccatcatcatcctcttcctcatcactcacttgtgtgatgtgctaagagtataaaataccaaattagaactactagttattaagctaaagaagagatactgccacttagcctttaggctcctccttcaaaatcgtaacagctgtttaaaataataatcataatcacgatgcagtaagttataaagcaaaagatgtgctggaacaaataatacacaagatttacttcaaatctaaataaaaatgcaatctttaataagaatgtaaccacaagaatataaaaagcaaaatattaaaatatcaaaattgtctgttactagagaaatatttttatttatttactttttttatttttgagtaattttgttgttgcccaggctgcagtgcaatggggtgatctcgcctcactgtaacctccgccttctgggttctagcgattctcctgcctcagcctcccgagtagctgggattacaggcacctgccatcatgcctggctaatttttatatttggtagagattggatttcaccatgttggccaggctggtctcaaactttttacctcaggtgatcaaactgccttggcttcccaaagtgctgggattataggcatgagccaccacacctggcctattactagagaaatataaacaaaatcagtatagtcttaccttagtaagaatactgagtaatagttaaaaggtaaaagctgtaacaattagagagccatccaaggtaggtcaagcaaaaaagtgccaataacaaatccagcacgataccgcgccccctctacatacaagcatttctatggaaacagatatatttataaaagcaaagaaaaagacgtggaaagacatgctcccagagcatgatcccagttacctctgaagagtatgcagagaaagaaagtactggaaggctcaaacttagcctcatctgttaagttctaatttttccaaaggtacacagtagtatgtataacaaaaaaaaaattttgttcaatgtttgaatcaatgaactgtgccaggcatgttactaaaagcactttattatctaatttaatccttacaactttgaggttagctgcagcacacaaaaccaacctgttgcataagctagtgcttttactcactatactgtactgttttgaaaaacagtttgtggccaggcattgtgaatcacgcctgcaatcggagaactttgagagggtgaggcaggtggatcacctgaagtccggagtttaagaccagcctggccaatatggcaaaaccttgtctccactaaaaatacaaaaattagctgggcatggtggcacacgcctgtaatcctagctacttgggaagctgaggcacgagagtcacttgaacccaggaggtggaggttgcagtgagccaagatcgtgccactgcactccagcctgggcgtcagagtaagactctgtctccaaacagacaaataaataaataaatgggctactctattcaggagaaattcagattttggagtcacaatgtttcagtgataaattccagggtgtgggacgtagattaagggtgttaagttcgtggccactgaagttacccatgatggtgttacataaaatccaagtttggtaattggctcgcctcaattttaccaaccaagttccaagttctaaagtgtgtatgtgtgtgcgtgcgtgcgcgcgcgcgtgtgtgtgtgttttaatgaatgtgggggaagtggaagaggttggtagatggtgacttaaaaatgaagtccccttaagactctaagactgtttttgcagacagcagtcttagtcttcttccaggctggagtggagtggtgcaatctcggctgactgcaaccttggtctcaggggctcaagcgatcattccacctcattctcctgagtagctcgaactacagatctatgccgccatgtccagctaattttttttttttgtagatatggggtttcaccatgtttcccaggctggtctcgaaccgccttggcctcccacagtgctgggattacaggtgtgagccaccacgccagcccagccttagtgttaacactgttataggttactgtaacatattggctcacagtgtgtgttctcgggtctgcctctttcctggttacctaatcataagtaagttacttctcctttctgtacctcagtttcctcaactataatttggaaataatatttcctccctcatagtcattgtgtgaattaaatgaacaatgtataaagtggtaaatactgaacacttgataaatgttagctattattaaaggagagactgatatttaaatgattacaatacaatgtaataccttaggataaatacatcaaaaacaacttttttccttatttattttacagctttattactgatttccctctaaaaagagacccaaataaatgtggagcgactcattatagagtaaggaatcacaaagtaccatagtcacgtaacaaaagcaaaaaaaaaaaaaaagcaattgttttacctttcaactgctgatgttatgtacaatctatcacaagaagcatagctgtgcattcatgagctgattgtattaacctctagaattttagaaacgagcacatctaagcatgtggatactctcttaccttacaaagtaaaagcaagcattttctattttaaaatttttatatctgtgtaaaacgaagaattcctggaggtcaaataagaaaaatataccaaactcaaaacactattaagtcatgaaacgaagactctgaggtagaagtcaagcaatataatccacaatttcaggtattcccagcaaccatcgcatctcgcaagtaagatgtatttttttttaaagtctcaacttccaaaaaatcaataatccattctgtaaaatcagatgtaaaactatgaccgagccgggcgcagtggctcacgcctgtaatcccagcactttgggaggctgaggcgggcggatcacgaggtcaggagatcgagaccatcctggctaacacagtgaaaccctgtctctattaaaaatacaaaaaattagccaggcgtggtggcgggctcttgtagtcacagctactcgggaggctgaggcaggagaatggcatgaacctgggaggcggaccttgcagtgagccgagactgcactccagcctgggcgacagagagagactccgtctcaaaaacaaacaaacaaacaaacaaacgacaacaaaaaaaaccaactatgaccgacagaagacacccaaacttttgtcgtggtaacacagtaaatgcttttactaaaagctgccaacatttctatcgtaagggggcagctggttgtaaccttaatgtccatattggtcgggatagtaaggttcttgtctgtgttgcgggtaattgttaccgcaggattgtccacgccactgattggatcgattgtcacttggccacccccatctgccgtccctgcctctgaactgtctgctatcttgcaaccgattgtctctgtttctttggttcccaccagctctgctattccattcctcaacaattggagaggactcaggagggcgtttcaagtattcctgatactcctcgtcatcttctgtgaatctactagcaaacatctcttcaaaatttggaacagctttggcagtgtcagtcattctgaaattcccaaagatttgaggcagctgtattgtttaatgtttaggttgtttaaatccgccaagggctgtgtctatctagctcgggccgaaccccgccagcgagacactaagagaccgcaggagaggtggcctctggcccaccacaccgtggaactccagaccaccccagctctccaatgtagcggagacccttccgctagccatagaaaataacttaagtcacttaagctgtacttggggtaatcaggttatttaatgaggtgataactgaggtgactacaaaagaaaagtctgggattgggtgtgtgagcaaggtgcatggggacagtggtatgttctaggttgaaggctcaccctaggccaagcaccgtggcacctgttttacaatatcataactttaatatcacatccttgcaagatatgtagcttcgttttactgaggaaagctcagaaaagttaaataactcgcccttgggcacacatgactggaaagaaattgggatttttattttagtaagtaagttggtcaggcacaagggcgactcagcagagggaacttcaaggaagtgtgagacaacagctggagccctgagctgggagagtggaggacgaattataaagagttttatgcctgccataatgagaagcttgtccttgaacttgaggggaatgctgagagtgcaaaggactttaagcaggccctacacagtggcagccaagcaggtcataaagagcaagatgatgcccaggcagatcagggattctcttatctacagagcgtccgcctaccagctccttcacagcagcggattttgctgcaagagaagaggcagcaggccaggccttttccttcgcccacagcgcctacgtcgaaggctcccaggctggttgctccactggctgcttgaggtcccctctctccagacccgccgaactggcggccggtgctttggccgatcccgcgccgctgcctcgggccttgggcggcagcgccccccgcccaacccgcctctgcagcgttcctggcgtcagcccctatcctccagcttcctccgccccaacctagggtagaaccccaaactccagtcccagtccacttccgcagcttcctcccctcagcatcgcaggtcggatcacgtgcgggttctgtcacgtgacatcaggtcacgtgaggccggtcacgccccgggcagcttggctggggctaggcttccggggctctgcggtcctcggcctgtgctggcagcctcggagcccaccgagccgggcggctgggatggtgagggcggcgggccggagaggggccggcctgggctggggccgccgtccctgccgccctcaggctcagcctctcttctcgtttttttcgctgcagatgaaccggacgacccccgaccaggagctggtgccggcgtcggagcccgtgtgggagcggccgtggtcggtggaggagatccgcaggagcagccagagctggtcgctggcggccgacgcgggcgtgagaggcgggccccggggacgcgagagcggcaggggtgacgcttggcttgcgcgcaggagggccggaccgcgactgcccctgcacctggcccgtcccgttgcctgccctcttaggaacacacgccccgtttagcccccgagaatgccaccctggcagtccccggccaccagggagaggggcagaccctgaccgtggcccagacgcgacgttcccttcatggggtttctggctcagctccatccggaggggagatccgtttccgccacactgagggattgctcgggcactagggaggcgattcctgttgggacctggactaaatggggtgggaaacaagccagtatgtggatatcctttaatgggattcttcaaatcgggggcccaaaaagctcagaactgttcgagtcccaaatgaataggatttttgaataagagtggtggttgattagctaacccttggtctgtgatctctgtagattgacaaccaaagaggacttttaaaaggagacagggttttgccctgtcgcccaggctggagtgcaagtggctcgatcttggctcactgaatcctctggggttcaggtgatcctctcacctcagcgtcctgagtagctgggactataggcgtccaccacacctgtctgatttgtttatttatttaattttagtagagatgggggtcttgctatgttgcccagactggtctgcaactcctggactctagcgataaccctgcctcagcctcccaaagtgttggattacaagcgtgagccaccatacccagtgccaaaaagggattttaaatttttccagaaacgagataggtgtccattagctcactgccactcttttgatgagctttcttagtgttttccaatgtcacttggttttagtacttgtcaaaccagcattccggccgggcacagtggctcacacctgtaatcctagcactttgggaggccgaggtgggcgaatcacgaggtcaggagttcgagaccagcctggccaacatggtgaaaccccgtctctactaaaaatacacaaaattagttgggcgttgtggcgggcacctgtaattccagctactcgggaggctgaggcaggagaatcgcttgaacgcgggaggtgcagtgagccgagatggcgccactgtactccagcccaggcaacagagtgaaactctctctcaaaaaaaaaaaaaagcatttctttcacattctaacactcaaaggtgaaaggaaatgggttcttttttgatgtgacatgcagaatagttacatgtaacattgatactactgtatgtttattttttaaaatagctactacagtttctacaggaattctcacagcaaactatctctaggacccatgaaatcaagaaacaagtggacggactaatccgggaaaccaaagccacagattgtcgcctgcataatgtcttcaatgacttccttatgctctctaatacccagttcatagagaatgtgagttatttagttatattataattccttttttgggagtaggagatattgtaattttaaataacttactgttaggttccctcctaaattttggtggaagtgtggttcttggtaattgtagcttttttctctgggattaacgcctcttttttatttgtaaagttttaagtccttttttccaagcctctaaaaaagtctaatgataaaattttcttatacttcagtgcttccatcttttgtcgttttgagagtagtcagcaattgtgctgaattgtgtggcactcacactgcctttgttgtggcgtgatctgtaaggacagctgtttacctggttagaccctctggacaccagcatatggtttcagttgttgattggggtcattctgttctgataaattatattcaggggatatatatgtctgcttgcaatattctcaactaaagtttatgatggccgaacttacaatatggaatcaactgtaaacagattactgagcttaaatctatgtgtgatttctgtctatttactgtttcttctaggtggtaggaatacataggtaaattagatagagcctctcccttggcaaatagtataattccagcatacaaaggaagtaagtatggctggagcagagtggagacttaagagatgaggatggagaggaagcttaggtaacagacctgtgtttctcatagggtgtcccaactttctgaatatcagcattcatttgtggaaaaaggattattaaagtaagcgatctcccgagattgttagatataaagtaataaaattttcagaatcacaaaattattaaaaaagcccaagatttagaatagttaagagaatgccatgtagtcaacttgtgcagcatgtttgtgcattttttaatagctcaagttaaatgccacttcctgtctttttttggagagctatatataaaataaagacattaataaaggtgttagagatctctttgccagttatttcctttaacagcaaaggagtacttatgagtttgaaaaataacaagtattcggccaggcgtggtggctcatgcctgtaatcccagcactttgggaggccaagacgggtggatcacctgaggttgggagttcgagaccagcctgaccaacatggagaaaccccgtctctactaaaaaaatacaaaattagccgggcatggtggcgcatgcctgtaatcccagctacttgggaaggctgaggcaggagaatcgcttgaacctgggaggcggaggttgcggtgagccgagatcctgccattgtactccagcctgggcaataagagcgaaactccgtctcaaaaaaaaaaaaaagtattcaagtaaaatcagtagttttctgattgtttacacagaatgtccatgcttggtcctgactatctcactggaaaagtcagggactctagactcaacttctctggtgtgcacagccccataatgttttcatcaagattaatttggtgtccttttaagcactcctgttcttttcattctgtacttttcttgctggatcaggtagtcagcacttctctgcagtcagtgctgcagcaccagagtcccaaaggatttgggaagtttctttttttttttgagatggagtctcactctgtcacccaggctggagtgcagtggtgcgatctccgctcactgcaagctccgcctcccgggttcacgccattctcctgcctcaaccttccaagtagctgggactacaggcgcgtgccaccacgcctggctaattttttgtatttttagaagagacggggtttcaccgagttagccaggatgatctcgatctcctgacctcgtgatccgcccacctcgacctcccaaagtgctgggattacaggcctgagccacggcgcccggcaagggaagtttactttgtacccagtgtgcctgtaccagattggtactagattggtaccagatcaatacttcagtgggaagaaatggggaacatcatacaatttttctcaatcacagtcttaggtcttatcttttctccagctcttttctagccaagttttcgtagattctgagttttccatgttgtagtttttgtggagtttttttggttttgttttattgtgttttggtaattgttctttatttctgtccaatactggggatttcctgttttccatccatctctccatccctttagccttagcttttttttttttcttccgagacagagtcttgctctgtcatccaggctggagtgcagtgacaccatctcggctcactgcaacatccgcctcccgtgttcaagcaattctcctgcccacacctcccatgtagttgggattacaggctcccgccaccaggcctggctaattttttttctatttttagtagagatggggtttcaccatgttggtgagtctgcttttgaacttctgacctcaagcgatctgcccattgcaacctccgcctcccgggttcaagcagttatcctacttcagcctcccaaagtgctaggattacaggcgcgagccactgcgctcggcccttagtgttaagtcttgatgccccttcgccttccagtctgcagccagaactcttctccggatgtgctggttgccgctgccaaatcttaattacttcccagaccttccataaggccacatgctataggtttttttcatttgtggcaaagcatgataatactgagaaaacagctaatgcataataaaactctgaaaaaatatacttgctgatatatatttgtaagtgatctggctttttttttttttttttttgagacggagtctcactctgtcgcccaggctggagtgcagtggtgcaatctcagcccactgcaagctctacctcccgggttcatgccattctcctgcctcagcctcctgagtagctgggatgacaggcacccgccaccacacctggctaattttttttgcatttttagtagagatggggtttcaccgtgttagccaggatggtctcgatctcctgacctcatgatccacccgccttggcctcccaaagtgctgggattacaggtgtgagccaccatacccggcaatctggctttttaatgttttattttcaatccctgacatcagtacttaggtgttacaattccagcttgaattatggtgccatttggtttcatggtaatttatcagaaacattcaaagtcagataggtttctgggttttattaattagcctcaggggcagccacaaagttgcaaactatattataaagttagtgaaacaatccgtactttctagggcgagaacagtcaggactttttagggcaagagaaattagtaccattagtaaaggctcaagaggggacttggagggagaagaaatactaattaacattggccagtgttctagtgtctaattagaaggcaacacaattctaaaggcttaattatctgttaatttaggaattggatcctgaaatagcaagtgccatagttaatgactttagtttgttaaatgaactggtgagggaggattttttctttttaaagtcaattgtttcaaaatcttagctttgtaaaattaaaaaaaaaattccagaatgaaacaaattaacctgtttatgcccaaggttagaattttttttgtgaaaagccagaccttggcaatgaccttgagcagtaggatatacataattctgacaagcttagtgttccaataatgggacactaggcataaatgggttaattttccagatcatcttcctgttgatttataaaagctgaattttggtcatttttccctccttttctacttttctattgaagaaacagatggagttgctgaaactgtcaagtactcagcaattagagagaaggaggtaaagcccaaaagccttattaacatataatttcctgcacaggtttttccctctccccctagacctgctttattttacataatgccccttgcttttgacactccagccttctcattccttggagatgccatatgccctgctgctacggggcctttgcttacattgcttcctatgcctctaccctttgattgacatctgtctgtcttctaggtctctgctcaattatattacttcctcctggaccctctgcactaggcacaccccctggataaaagcagctgaagcatcacattctttagtagacttcttacaattgtaattttacaattattgatgggatttgatgagttggaccctcccactaaatcaagccccatatttttaacaacaaatatatttgaggggtccagcacaagcctgatatttagggatccagtgaatatttgaatgaatgagagtacgcataaatgaaaggggaccagggctgtgtatagtctgttactctccagccctggtccctttttccccagttcccctctttccccttttaccctgtctccccagatgaggagcaataccaaagatatttaacagtcctgggtatagctatctgactgtaaattgatcacaaaacacatgaagctgtgagtttagcaggtgaggatgaaagaagttagcattggttatctgctggatatgaagtacttgaggatgcatagtcctgctcaccctgaaaagatcccatgggctttaggtcccatgggtttaggtttcttagatgtcatgtttggctttctagctgcaggctgctgatgggtaaccatggtagctgccaggtcttaaagtctcacttttgagatttacttaactttttggagtcctgactttgaaaattaccaaagtaatccctgatctttatagagcaattaggaaaagtaagaaaaagaaaaatcatgtgaaatttcctcagcttgaggggagcctctcaacgtttagcacatatattctaagtccatttcccatgcagacatcaggcttaaaagaattgaacctacagtaggccgggtgcggtggctcacgcctgtagcactttgggaggccgaggtgggcggatcaggaggtcaggagattgagaccatcctgactaacacggtgaagctccatctttactaaaaaatacaaaaaaattagccaggcgtggtggcaggcgcctgtagtcccagctactcgggagcctgaggcaggagaagggcatgaacccgggaggcagagcttgcagtgagccgagatcccgccactgcacttcagccagggtgacagagcaagactccgtctcaaaaaaataataataaataaataaataaataattgaacctacaaaaaatcagctaccccaaattaaccaaccattgaacttttcagtgtatttttttctgttcttgttttttaactttaaccttttctagatgactgtgtgtgtgtgtgtgtgtgtgtgtgtattttcatttgcagcctactttttttcttaatgtgaacttatttaacccatctttgagacttttgtgaatttaatttttttgttcttaaaccgtatcataatttatttaataatcttctaatattaaatgttatttatgaaatgtttcataaatttcataaatgtttcataaataaatagaaaagttcagagagaaaccacaagtgctaagaaaatgtagcacctagcatcagtggttttgtatcttgccacatttgcttcaaaggtgcctacccaccatattcgtccttaactctaatcattttgggtggggattccttggtatctctgcctttttattctttttttgtttttgagacaggatctccctctgttgcccaggctggagttcagtggtgcagacagctcactgcagcctcaaactcctgggctcaagccatcctcccatctcagcctcctgaatagctggctaggaccacaggtgttcgccaccatgcctggccaactttttattctttttacctagagagggatttcatttttatcccttatagataacctttattgtgtagttgttcttttcttcattgactattatgtatgaatgtttgtgtgtgtttatgtgaaaataaaatcaggcctccatggaattgtgggtctgtttctgccctctgctgtttgttttgtttctctgctgtttgacagtatcataatcttaaatactgcagatttctaatgtcttattagggcaagtccccataatctgtttttattcagaattgtcatggttatcaatctttggctttttacttttctgtgtgaatttgaggattatcttttacttatttatttatttttttgaaatagagtttcagtcttgttgctcagactggagtgcaattgtgcaatctcggctcactgcaacctctgcctcccaagtttaagcgattctcctgcctcagcctcctgagtagctgggattacaggcaccggccaccacatcaagctaatttttatatttttagtaaagatggggttttgccatggtttcaccatgttggccaggctggtctcaaactcctgaccgcaggtgatcccaaagtgctgggattacaggtatgagcctcccaaagtgctgggattacaggcatgagccactgtccccagcaggattatcttactatattgtgccacagaatattttattagcgtttgattggaattacatagaattataaatttggtatttgtgactttctgctggaaatcatgataccatgaacattctgatgtttgcgtttatgataattttcatgggagctaaatttcaagaagtagaattttgggtcagaggatatgatcatttaaaagcaacattgtttgatcagattggcagatacttaaagatgggtggacaggagccattgctggcaaaggtttgggtaaggggcacttgagtatgctgctagtgacagggaattctacgcatttgtgcatagaatctgggaatgactattaagatttatttattccctctctaggtaaaatccttctctaggtatataaataaataataaataataaataaataatcagtttcagccaggcacaatggctcacacctgtaatcccagcactttgggaggccaaggccgatggatcacttgaggtcaaggagtttgagaccagtctggccaacgtggtgaaaccccatctctactaaaaaaaaaaaaaatgcaggccgggcatggtggctcacacctgtaatcccagcactttgggaggccgaggtgggcgaatcatgaggtcagattgagaccatcctggttaacatggtgaaaccccatctctactaaaaatacaaaaaaaattagctgggcatggtggcaggcacctgtagtcccagctactcaggaggctgaggcaggagaatggcgtgaacccaggaggcagagcttgcagtgagccgagatcgcaccactgcactccagccttggcaacagagtgagactccatctcaaaaaaaaaaaaaaaaaaaaaaaaaaaaaaaagggcaaaaacaaattagccgggtgtggtggtgcacgcctgtaatcccaattacttgggaggctgaggcaagagaatcatttgagcctgggaggtggcggttgcagtgagccaagatcctgccactgcactccagcctgggtgacagagctagactctgtctctaaataaataaataaataagcaggaagggtaggagagctctaaatatatgcacgtgttagcttatatttgtgttcagagcctcaggaaatgagcatacacaccaggcttaaattgggtattccaaggatcaggttggggatagggagggaactattttaaaatacatctcttttccatgtgcctttatattgacttaaaattttaaaaattgagatagaattcacataccataaaattcagtcctttaaaaagtatacaatttggtggtttttactgtactcaaagttttataatcacggccactgtctaatgccagaagattttcatcagttcatttatattgacttcttatttctttctttgtaaaaaattttaatttcatttcattttatttttgagatagagtctcactttttcacccaagctgcagtgcagtggtgcaatcagggctcactgcagcctttacctcccaagctcaagagttcctcctgactaagccccacaagtagctggaattacaggtgcacaccaccatacctggctaatttttgtattttttgtagagatgaggtctcactatgttgcccaggctgatcttgaactcctgagctcaagtgatccccttgcctcggtctcagagagtgctggccttacaggcgtgagccaccgcacctggcctatattgactttttataacaagcatgttgtacttcggtagtttttaaaacataaaaatgattttaaaaaccaagaatcacagtgatttggcagagcagtgggtcttttctggaaaagagagtcttgcctacccatgctgtcagggttagtcaaatgcccaggctttctggcaagtcagtggtagatttttctctctgctttcatacaaatgggataataaaaatttatcagccattttaagcaactgaatgaaaataagttttgcctttaccattttccttgttcaaaatcctgaagttctagtttcctagttgataaattacatcagttgacattctccataagctggggtcagaatactgtatcattgcccatcaacattattaggttaaatgaaaaggtgtgaaaactgatatcttactgtttttgcaactcttggtttacaacgaggttaaagtttcatcatgtttcctagtcatttgtatttaaattttttttttttttttttttggtgaatggactattctttgctgttagtccatgacccactgttacggacacccacctggtagtggtctcagccctttgctgaataaccatttccttccgcatctttgtccttagttactgtgtgaattcttatattgtgatttatttccaatgacgtgttgaccttttaacattgagtttgcttccatatttagcgtgtatatgatgaagaagtggaggagccagtactcaaggctgaggcagaaaaaacagagcaggtacttgtataaaatcactcttagctgagtttctgactttgaaaagtgtggtggagatcgatgtgttatgtgggaactgggggatggtgggtggggttgggaaagggagggactgctcctgacagcagcccaagaggggattctttcctttgtttctgaaatgtagtatattaactaatacagagatcaaatccttgaattctgatataagaatagagtagaagtcagcaaacttcttttgtaaagggccagatagtacatattacagatttggagggtcacagaggtcatttttttcctgtggcttcctgagttacagatggaccagccttcttcctgagatcttctcacaccagagcccaaaacatagctaagaggttctgggtcacactgacttcttagcactccagcagagatttctttttcttccactcaggaaggcacatggactgtgaataagtttattattggagtagctttgattttgttctcatttattcagaaaatatggatcacctgtaaaggttggccctttgtcagcaattattacttgtaacagatgaagctgttagactaggaaaagggtattcaaaaccagctatagttctgcctgttgccagcatttttttaaaaaagttattttattttattttttatttaaaaaatttttttattttgagatggagtctcactctgttgcccaggctggagtgcagtggcacgatatcagctcactgcaacctctgcctcctgggtgcaagtgattctcctggctcagcttcccgagtagctgggactacaggcgtgtgccaccacgcctggctaatttttttgtatttattgtagagacggggtttcgccatgttggccaggctggtctcaaactcctgacctcaaatgatccgccagccttggcctcccaaagtgctaggattacaggtgtgagctactgtgcccagcaggttattttatttttaatagaactcaaggatttgctagccatttaagtgcagtagtatctggttataccaattcagggtttaatttgaaggtgataggtatttagtgtactatttttaaaaactgctatatatttcatacacattttcacaaactcagtacaatattagctatttaactcagaatcaagcatatccaaatagaaaaatacacaaccaagacaaaaaagttcagttagaaagacttcagtacttgagataaaagactaaaatgctcgtagggtttttttttttttttgcctttggccctcagaacaacactgtgtggtttggttccttctagaatatttgtagagggggaaatgacactaaatatttttcggtatttctcacaatggcacacttgtgtctgtggggactgccattgagaactgctgttgcaggaagaagacacctgagggagattctcagcctgttggtgatatgaacaaaccttttttcttgaatggggcattgttgtagggtatacacagaatagaccggagatgaaaatgacccccttttgatgtagaacagatttataaaataattgtaattgtccagttttttttttttttgtctctttaaactgtaattgaaaaatgagacctctgtgaccttccttctaagtcttaacacctaaaattacccaagggataaccagggctcgtgggatagtcatggtgagtctgagagtctaggccctccagcagtggggaaacagcatgcattcattgttgggatacttctccacacactagttgtacctctgcttttgtagacgatgacccttgagctctggaaccttaggtagtttgatgcatgtccagaaaggggcaaacttgggatttaaaacttgcagtcttactccaaagtctgtgtcaaggcattcagcagaatttgacttttttaacatttttaataagtttttttggagcttgaggctaggctttagagaacattcacagtattcttttggggcagtatcagtatattggagacccatactgcatggtatttattttgtaggagaagacacgagagcagaaagaagtagatctcattcctaaagtccaggaggctgtgaactatggcttacaagtattggacagtgcctttgagcaacttgatatcaaagcaggaaactcagactccgaggaagatgatgctaatgggcgggtggaactgatccttgaaccaaaggtgaagacattcaacttaaatatttattgcacaactattatgtttgggctactttaattgggcacacgattagtaagtcatggacttaacctctgggaagtgagtatgtcacttagtagtctcacattgactccaccagaaagactcgctttacctgagcactgatggagtacttgtgaggtgcaaggcaacatgtcaagttggggtgcaaagatgcagagcatggcctctactctcgaggtgtgtgttgcagtctggtgggagagaggagacatacatacgaataaccattgtaaatgccctgagagagaattgatttccagctggaattttggggcaaagatgatatttgaattggggtttgaagggtggggaggctcaaaagagacagagagtgttgggaacctgaaattatgtagcttgggctaaggaagactgcagaagaactgaaaggcatttgggttgtttccggtttgggcaattattaaatacaaatgaagctgctgtgagcattcatgtccaggctccctcatagcctagtgagtgttggttgcttgacacactttctcccacattgttcaaagagacaattggggtgacacagagtctctcggtagtgaacacagaaagttaccacagtgatttatagaaagaggccttgtgacacacaaggccttccgaattaaaacatgccacagaaccaaacccttttttttttttgagacggagtttcactctgtcctccaggctggagtgcgtggcacgatgttggctcactgcaacctctgcctcccaggttcaagcgattctcctgccccagcctcccgagtagctgggattacaggcgcccaccaccacacccagctaatttttgtatttttagtatagacagggtttcaccatgttggccaggctggtctcgaactcccaacctcaggtgatccgcctgccttggcctcccaaagtgctgggattacagacatgagccaccccacccagcctgaaccactcttctagtcattctgtagctgcacatttctcttccagtttgagctttgctgagtcacaccaaattgaggcagatcatttggcactgaccagtacacttgctgcttggattttcactgtatgcctttaaaagtcagcagtggactctgggaaatggattgcctggaccacacttgatacttccaagacacacagcactttctcccttttttttttccccttgcagagaaagttgtggaggtacacttttcttttgtaggaggatttggggatgtcttctgagtcagtgagaattagtccaaattaacgctgtctttgccttatgctccattggttgctgtgacgtcgttgaacctttactttaaccttcccaatctttctgttgttgtgtgaaacgtcagaattattctcccctgccccagagtcctttgacaaggaagagatatcattgccaaagggcaatgcctcacaggggacagggcagcatttccttcagcagtggaggtaggaggctgtgcaagggtggagcactttcttgaccctatttttttttttttttttgagacagagtttcactcttgttgcccaagctggagtggcgcaatctcggctcactgcagcttctgtctcctgggttcaagcgattctcctgcctcagccttccaagtagctgggattacaggcatgtaacatgacacctggctaatttttgtattttttagtagagacggggtttcaccatggtgaccaggctggtcttgaactcctgacctcaagtgatccgcccgcctcggcctcccaaaagtactgggattacaggtgggagctactgcaaccgaccaaccctaaatttttaatgtgtgtgtggtgtgggactgacaggagtagacggctgacatgggcagatctccagcatgtgctgttggggccacagtctcctgccctcactctgttttctcatctggtcttattttaccaacttcacttttctaaattcaacagtgtggaaccactagggggtattgttcttctgtttattgagttataatcttttttatttatttatttatttattttgagtcggagtttcgctcttgttgcccaggctggagtggagtgatgtgatgttggctcactgcaacctccacctcctgggttcaagagattctcctgtcttagtctcctgagtaaatgggattataggtgtgcgccaccacacccagctaatttttagtattttcggtagatattgggtttcaccacgttggccaggctggtctcaaactcctgacctcaagtgatccatctgcctcagcctcccaaagtgctgggattacaggcatgagccactgtgcccggcctaatctatttttatattaaaatatatagatatattatgtctcattagtactgctttttaggggacagctcaccagaatgttcagtttctttccttggtcctcctcttcttggaccttatactaggaggttgtacccttttccctgtttgcttgctgctgatagacttttggtaggcttttgccatttttgttaaattttgttaattaggcccttggggagggagattctgtgtgatacagctttactttggcatcttttttctttttttttttttttgagatggagttttgctcttattgcccaggctagagtgcagtagtgcaatctcagctcactgcaacactgtttcctgggttcaagtgattctcctgcctcagcctcccgagtagctaggatgacagttacccgccaccatgtcccgctaatttttttggatttttagtagagacggggtttcaccacgttggtcaggctggtctcaaactcctgacctcaagtgatccacccgccttggcttcccaaagtgctaggattacaggcgtgagccatggtgcccggccttaccttgacatctttacctaggatttgacttttaaaaaaatcagtgaaaaaaagaattttttttttaacttttagtcctgctgtgtttcttattctccaccttcgttatgtagcttgtttgggatagtcagatggaacagggtatcaggtggcacatgtaagtttgttttcaactgaaatgtttgacagcctattcctttcatcatgtacaggatctatacattgatcgtcctttaccatatctcattgggtcaaagctgttcatggaacaagaagatgtaggtcttggagagctgtccagtgaaggtacttttcttcaccaaataattttattccttaacatttcttttttattttaaaataatttcaaattttacattaaagtttcaagaatagttcaaagaactctcatatacccttcacctgggtttaccagttaacatttcaccacatttgttagattgttctctacatatacgtaatattttgtcttgagcctatttgggagacatcatgctcatgccctgttacttctaaatgtttctctgtgtgttttctttttttcttttctttgtctttttctttttttgagacagagtctcgctctgtggcccaggctggagtgcagtggtgcgatctcagctcactgcaacctccgcctcccggatttaagcgatttttctgcctcagcctcctgagtagctgggaccacaggcgtgcaccaccacacctggccaatttttgtatttttagtagagatggggtttcaccatattgtccaggctggtctcgaattcctgacctcatgatctgcccgcctcggcctcccaaagtgctgggattacaagcatgagccaccgtgcccggctctttttctttctttctttctttcttttttgagccggagtttctctctggtcacccaggctggaatgcaatggtgcgatcttggctcactgcaacctccacctcctgggttcaagcaattctcctacctcagcctcctgagtagctgggattacaggtgcccaccaccacacctggctaatttttgtatttttagtagagatggggttttaccatgttgggcaggttggtctcgaacgcctgacctcaggtgatcctctgtgtgtgttttctaagaacaaggacatctcttgtataatcacagtagaattacaaagccaggatattttcctggacataagggtattatccaatctgctgctatgttcacattttgccgtttgtcccagtgacaccctttacagtctctctcttttgttctgtggtccgggactcaatccaggaccagccaccacatttggttgtcaaatcttcagttatcttttaatctgatgccatttctcagcctttctttgctttttatgaccctgacatctttaaagagtacaagcaagttttttttttatttgtaatgaataatttttggggggagagatacttcaagactacataaatatgtaattcctcaccataatgacactttcaattccagtaagtgggtatagatggttttatcaagatctctgtgatgctgttgtatggtggtttgtgattttgagctaaggacattttcttgtgaatattggtgtggtgacccttatctctcttctcaacagaaggctctgtaggcagtgatcgtggcagtattgtggacactgaggaagagaaagaagaggaggtaagggctgtttggtatgaccaggtcacggtgggcagcaagcttaatttaagatgggcctagcaggctaagtaaatagcataactgtgaattcgtaatctgcttccataaagcttttaacagtgatagaagccacattctgagttttttttcccaagggttagatttcctttttgccttatgtacaataatagggaaagctgctttcatctcttccactattatcctctctcccaccttgccaccaaatatctctttcacccaatatatttttgagaagggcagcttagatgttttggtggaatctctgcctgggatatagtctttgagtatattccgtctttgaataattctaagggaaaaaatctacatttagaacttttgtaaactataaaacctagagcaggatataccgaaagccaccacttacattctattttgctgctgccgctagcgctttcatatccacagagcataatttcatttccttgtctagagtttgagtctgtgggccttgactacagttgaatctgtagttgttctttagatgggatattcgttattggaaaggacacagccatgttgcaggagagtcctcgagtatgggatttccgaaaggagacagtgttgtgtatgtgcttttctcttctggttggtccccctttctgcactctccctgcccgcctttcttccagtcctccaaagaaaaacctgacagcaggaaatgagcttttcttaagtaactttcgtataacaaaagcagtgctcattaggggaatcccttgcttttagccaccgatgtggcacttctatgtggcacttcatcaatagttgctcgtagcaactattgatgtccccttcttgggcctaatgaagtagttatttttattttttatttttattatactttaagttttagggtacatgtgcacattgtgcaggttagttacatatgtatacatgtgccatgctggtgcgctgcacccattaactcgtcatctagcattaggtatatctcccaatgctatccctcccccctccccccaccccaccacagtccccagagtgtgatattccccttcctgtgtccatgtgatctcattgttcaattcccacctatgagtgagaatatgcggtgtttggttttttgttcttgcgatagtttactgagaatgatggtttccagtttcatccatgtccctacaaaggacatgaactcatcattttttatggctgcatagtattccatggtgtatatgtgccacattttcttaatccagtctattattgttggacatttgggttggttccaagtctttgctattgtgaataatgcaaggaaatagagacagtatagtccaaaatgtaaaataacacaaactgactttcagtaatttagttagttaaatgtgcaactctttaaatccaaaggcaagagttgaaagtgcaggtgatgtgaacaaattgttagaggcatttaagtgaaccacaaaaattacatgttaactggaacaacccttcacaatattgccagctacccagcttatctgcaccttgatacttaaggtgaccagtagtcagtacaaagagactgagtgtcagagctttttctccacttgacatagaatcagcctgccccagagacttagacctgcaatcatttctgtgcttctaagtaaagcccatttaacaacaaagccttttcttacccataaaggagtcagatgaagattttgcccatcacagtgacaatgaacaaaaccaggtaaggctcatatattgaaatgactttgtttttacattttaattgaagcatagtatatatactaaaattactttggaatgatttatgaccaagtgaggattttttcatgtatacaatttattttcctttaagcatttcatgtatttaggctaactacctcctttgtatatattttttccaattttgctttatagtttatttttcttagaaaagaagtttcaaagaagtgaaaagcacaattggaaaacagagcctctaaaagaagactcagttacccaaactgaactactttgcatgagtccctcttctgttttaaaattggagacaatctagcagtaacattattgagtattcacaagatgaaaacttcttaccctactgtcttagcacggttatcttaatttttgaatatctaaaggcgtattcttttcatagtgtgcatcgttcattttctgccattttatgttaacattttataaatgtgtccttatttattattattatttttttgagatggagttttgctcttgttgtccaggctggagtgccgtggcgtgatctcagctcactgcaacctccgcctcctgggttcaaataattcttctgcctcagcctcccgagtagctggcattacaggtgcccaccaccatgctcagccaattttttttgtatttttagtagagatggggtttcaccatgttggccaggctggtctcgagctcctgacctcaggtaatccacccaccttggcctcccaaaatgctgggattacaggcgtgagccaccatgcctggcctccttattttaaatagcctttgcagtttgcgttgtaaacttctatacttttaaacatactgagtatgatactgtcatagtctctaaatgtataagggaaagagtttatttctagagttgtatttttgatgtaataatgtattcaatattttcttttcttttttttgagacagagtctcgctctgttgcctaggctggagtgcagtggtgtgatctcagctcaatgtaatctccgcctacagggttcaagcgattctcatgcctcagcctccctgagtagctgggactatgggtgtgtggcaccatgcccggctaattttttgtatttttagtggagtcagggtcttcccatgtttcccaggctggtcttgagctcaggcaaaccacccactttgccctcccagagtactgggattacaggtatgagccaccacgcccagccaatattttcatatatagaaatcctttgcttcggtgaactgtttcttcagaatgaggtggtatagagttatgttaataactcttaatgtctggtggacattctaaattaagtattatgcatgtagattttcctacaatctcatcactggggtgattattttaaatttcttttagttaaaaatttgcatttaaatttcttaactgggaaatatttttttcacaaaaatgtttaactatcaaatgaaggattttatactttctggttgttactgtattttcctggttgtattcataaatgtggttgatctctataattttaacgatcagtctttcttcataggatatttgtttctatggaatttcctattaagatctgtaaatgcaaacagtttttctttccttttttttttttttttttttttttgagacagagtctctctctgttacccaggctggagtgcagtggcacgatattggttcactccaacctccacctcctcggttcaagtgattctcatgcctcagcctcccaagtagctgggattataggcatgtgccaccatgcccagctagtttttgtatttttagtggagatggggtatcgccatgttggcgcggctggtcttgaactcctgacctcaggtgatccgcctgcctcagcttcccaaagtgttgggattacaggcgtgagccaccacgcccggccacaaacagtttttcaaaaacagtacagtatagtgagtaaaagcactagcttatgcaacaggttggttttgtgtgctgcagctaacctcaaagttgtaaggattaaattagataataaagtgcttttagtaacatgcctggcacagttcattgattcaaacattgaaaaaaaatttttttaattatacatagtagtgtgtacctttggaaaaattagaacttaacagataaggctaagtttgagccttccagtcctttccttctctgcatactcttcagaggtaactgggatcatgctctgggagcatgtcattccaagtctgtttctttgcttttataaacacatctgtttccatagaaatgctgtagtgtttgcagagggggcggggcttggtatcatcctggatttgttattctgcgcttttttgcttgacctaccttggatggctctctagtcattacagcttttaccttttaactattactcagtattcttactaaggtaagactatgctgatgatgtttatatttctctagtaaaaggctgggcatggtggctcacgcctgtaatcccagtgctttgagaatgtaatcccagcgctttgggaagctgaggtggttggatcacctgaggtcaggagttcgagaccagcctgcccaacatggtgaaaccccgtctctaccaaaaatataaaaattagccgggcgtggtggcgggtgcctgtaatcctagctactcagagggctgaggcaggagaatggcttgaacctaggaggcggaggttgcagtgagccgagatcaccccattgcacttcagcctgggcaaaaagagcgaaactccttctcaaaaataaataaataaaaatatttctctagtaacagccatttttgatattttaatattctgctttttatattcttgttgttacattcttataaaggatacatttttaggccgggcttggtggctcacgcctgtaatcctagcagtttgggaggctgaggcgggtggatcacctgaagtcaggagttcaagaccagcctagacaacatggtgaaaccccatctctactaaaaatacaaaaaatttgctgggcgtagtggtgcatgcgtgtaatcccagctactcggaaggccgaggcaggagaatagcatgaactgggcaggcagaggtttcagtgagccgagatcgtgctgatgcactccagcctgggccacagagcaagactccatctcaaaaaaaaaaaatatatatatatatatatatttatatatatatatatttatattttatatatatttttatatattttttttcttagattcaaagtaaatcttgtgtattatttcttccagcacatcttttgcttcataacttgctgcatcatgtttatgattattattttaaaaagctgttacttctttgaaggaggagcctaaaggctgacagtatctcttctttagcttaataactagtagttctaatttggtattttatactcttagcacaccacacaaatgagtgatgaggaagaggatgatgatggctgtgacctttttgctgactctgagaaggaggaggaagatattgaggacattgaagaaaatactagacctgtaaggaaggctgtagttgctatcacttggcagagttttagaaccaatgacttgtttttctttttattgtgacttactttgtacatcactcattttggcatatttgtcatttcatttacactttggaaaataatggcaagcatctcaaattgcctcacaagtaccactttcttgtccagatgttatgattttatgagtcagatcattcagaatatgtctagttccagagtttgaagaccatagtgctcctgtctctccacccattcacctttttcttattttcgtatttagatttttaagtattaaagtcaagtattaaaaagaataaggaaataaagggcatctccctttgaaggaacattttatgagtcctattccttgggtgagctgtatagggtacatatgtttaaattcatttaattaaactctgttttctcctcagttcaatttctttgctcttgtatacataatgttgttaggtgtccaaagtgaagtgtactagtttgttacaaaaaagcgattcttttgatttctcctgctgtagaaaagaagcagacctacatcgtttgcagatgagctggctgcccgcatcaagggggatgccatgggtcgagtggacgaggagccgacaagtgagccccagccacgttgatggggagtaggggaggagtagtgcagggccctctgctggcttcaccaaaggcggatttctctttttattagtaattactacatatatttattagtaattgctacatataatttaaattgtagcgcttattccttttttggttaatgggctcctttagataactgaacactgtggacccacaagaaaaacgtacatgtacacatgtagataaccctttacatataatttcaggggattaatggaaactccagagaaccatgggcaacagcttaagaattcctggctgaatatttactcctatattttgaacacgtaagaatgtgctatatagcatattctagttataacagggtagaaagataacacaataattctttcaacaaatacaatcctgttatgcacatgagcctggtacgaaagcagaagccttctgccttacaaagagactcttgagtgcccactgtgggcagggccagggagttcagtgctctggtgcagctgagatgaaaggcagatgtcttgctcttagctgtgagttatgaggatgacagacgtggaaagaaccaggatgtgtatactgagggaggacttagtactattaaaactgtgaactgttcttcaagccttaccctcaggagaagcaaaacctcggaagacactcaaagagaagaaggaaaggagaactccttcagacggtgggccttttccctcaattctgttattttaggagcctgttgactaaggaatgttgcttacataattcatgaagtactgctttacatgctgttttccctctgacaaatgggtctgtctccatttacttttctaaagcctctgggctggacgcggtggctcacacatgtaatcccagcgctttgggaggccgaggcgggtggatcatgaggtcaggagtttaagaccagcctggccaacatagtgaaaccccatttctactaaaaatacaaaaaattagcttggcatggtggtgggtgcctgttgtcccagctacttgggaggctgaggcaggagaatcacttgaacccgggaggcagagatggcagtgagccttgatcgcgccactgcattccagcccgggtgatggtgcgagactccatcccaaaaacaaacagaagccttggaaggcatgttttggggtgctgggaggatatgtgggtgtggagtaaaaattcctgtagagatttgatttattagattttacagcaatcatttcttgtcttcctagaattcttagaagtatagaaacttaggaatctcaagcatttgttttcaataaaggatacaccaggccttttcctgcaaacagccatgtcgattacattagacttgtccctgtgtcagtttgcagatccctttgtttattctgcccttccttcccccagattggttggggaatgggtcttgaatgtggcgtctgacccgaatgcttgcttcagagtaaatctagatccagggtgctggcctagagaatgaatgctgtgtgccacagacgtggacagacttgagagtggaggcccagagagtcttttgagggtgtcagtggactgtgccaggggtttagtgtgaaattcatcagactgcctcacactttgttaaatagtgtcagataaactccatgccagtttggagacacagcagatgccaacccgggaatttgagttctggacccatctttaatactccctgcaaaacattgctttctgtttgctagatgaagaggataacttattcgcaccccccaagctgaccgacgaggacttctcgccatttggctctggaggtggcctgttcagtggcggcaaggggctatttgatgatgaggacgaggaggtgagtccatggcacccagcaacactccctgcagctagctgtgtcaggggtccacagggaagatataggctttgcttgtttagtgggggaaaaacagtttctcagttggaagttgcttctattttcatattttgggacattttgaactaagaatcacagagtgagaaatgccgtatccttctatgctttgttaggtgaggagaagatgtgcacgtgttaatgtgaataatttactaggtgattgtttcttgccttatctgttgtcttccacgtttgtttttaattcctggacaggcctaaattattttagggtctgattttgccatagttatcactttgcaactgattttctggcagagtagtaaatatgtagctttaaatcttgtaggttatttttccttaggaatcctcacatgcagctatgctttctcctggttttttgaattctttgtcatataccttatttcaaccagagtgacctcttcacggaagcctcccaggatcggcaagctggagcctctgttaaggagggtaagctggggctgggcagctgcgtctccgtgtgcagagttccaaaactgtctttctcactaggagatggaacaaggttgttcccaagccttgtttctgtgtcaagcaagaagctgttgtttttactgcggtccagttgaaagtaattcatcttcactaattcatgtcttggaaaaaacagtaccatctgtaaacccataccacagtcttgcctctttgttaggagagaactcatagaaagtcaaacaagaaaagtaccctagagcaatgttgaggatggttttcattgaatgaagtttaatttaaagaaacatttttaacattctgtatataagttggagaccagtaattccccaacccagtgtgcattaaaatcatctgtgcaggtttttttgtttttttgttttttgtttttgtatttttagtagagacagggtttcaccatgttggacggttggacaggctggtcttaaactcctatcctcaagtgatcacccgcctagacctggcaaaatgctaggaatacaggcatgagccactgcacctgtccccttggtgcagtttttaaaaaacacaaatataaatatgttttttttttttttctttttttttaacctacaaatgttactcaataggtttgtggtagttcttgggacttgggaattagtgattctaagtgccgagtctcccgggcgcaggcatcagagctgggccttggaggccgctccttgtgcctgctgtgcgggctgctagcctggctctcctctgctttctgctgtccatgttttggcatcagtgacttgcttggtttccccctttgctcttatgtctttatttttttactgatgactcacatgtttttgcggttctttttcacccgttcattctcatccaactggaatgggtagaggtggaactgtttgggggagccccggtcatgctgtccctgcctctgctgtgctcacctcctcccttggtgtcccccagctgacccactgctgtggcttgatgacggtcagcatgctcttccatttgagtcacagctcagattgtgttaatcccaaaaaaaaagtcctgacatcggtagagaagaaaatactaaggaattttaaaatggcttgttcaggaaaaagtagtttcaaaaggtctggtactagctgtgtgttacattgcacgtatttcaggaagaaaatagcaaggaaagttatttcccttgtaaaatggttaccccttgctttctcattctagagtcttcatcatccaaacctggaaagaaaatcccagcaggagctgtttctgtatttttaggtaacataacttaggtttgttttctaaaaactacacaaatactgttttttgcatttcaaaattatcatcttctaaagtctggctggagatgaggaagtacctgggagcttcaaagggctttgagcatcttatagaaagagctcatttactgatattagctcttattctcctagagctcagtggccttggacttttttgtgtttgagcgacctggtgattctccgttgtgagatgttctgtagcagtaatggatggaggctattgggccctgttatgcattttgtggattaactgaaatggaaagtttttggtgggtgataatttttttctgtaaattcaaccggcccacactggctcacagctgtggctgtcttgtcccttcactcacaggagacacggatgtgtttggtgctgcctccgttccatcactgaaggagccacagaagcctgagcagcccactccaaggaaaagcccctatggtccccctcccactggcctctttgatgatgatgatggtgatgatgatgacgactttttctcggcaccccacagcaaaccttctaaaacacgtatgtgttcctgcctccgtttctaggacttcagccagaaaaagaatgttgcctaaaaagaacataagctcacctagttctgtatctcttacagtgccagaatcccttctccagcattcctgtcattgagttgttgtgtctgtacttacataggtgtggtgcctgggaggtctgttttatgacccaatcttttctgctctgtaagctaattactatgattattttccttatagagagctgaaatccttttctgtataatttttgcttgcaatttccagttctgacctttggtattgtaaagttttaatcatcctttcttccagccgaccttagtcaattacatgagcagcaggttgtgtgccggccatttatttcccagcttctcatttctctgccaaaaagctcaggtggccttggtctttcctcagatgatgttttcatccccttggccactttggcattctcctctcttttcctcttaaatgtaagtcctatgtcctgaagtcattcccataaatcatttgtttttaaatgtgcagatgaatcttccaggggcttttgtcaaaatgaagattccgattcagtaggtccagggtggggcctgagaatttacatttccagcaagcttcatggtctgtagatcacacttcgaatagcaagacttagatccattgactgctcttccagaaaagaaaggtagatccctagatccctaaggtgcacatgattttcagcaactttaaaaaataaaaaaggatggcataggaatggatggaactagaatgcatttagaagccggctgtctggactcactctcttccagtgttaggtgtagaaagtaaggatggaagccgaagtgtgagggaaaacgatagcctagttaatctagaaagagtgcaaacggatgcagaatgcacacaggtctcagtgaagatgacaatgcacacaggtctcggtgaagatgacagtgaatgaaggtagtagtgctttttgtagctccacagggctcttacttagtggatatctttgagaactgatttagaatccctagtaaattgatgctgctttctttgacaactcctagtctcttcagacattcatgagtcagtgacctcatttcagcaacacatgccctattcggtacagcagtgcttatggtgatgaaaggttggaaaccacccaaatacttatcagtagagtaagctatggcccttctattcagtggactattctgtgacagttaaaaagaaaggggtctacgcttgttgacttgggaagattttgtaggtacattgagtggaaaacacaaatggtaagacattgttcaaattatcttcttatttatagccttatttataaataactagtgttaattcattagtacatcctttgggggaattagaagcatgtatgctgaactgttcccaatgttcatcttgtttgagtagactggtggaattatgaggggatttcattatttgcttttatctgcttttgtacagtttgattttttttaaagcaggagccaagccttcatttctcagattccttagatgattgacttggtggccctcttaaatgatctttcttcctctagatctctcttcaccttgtaagccagtccaagctactctaagcacaggaaatggctgcttggataagcatgtcagccacgtggataaactatctgttctgtctttcaactgaactgctactatgcactttgaaaaattccaagggaagagtatagttccacttactatttctttataactaatcaagaaacaacataactttttatgtttattctttgggagggaagaattttttaatctgtgaattttgtgataggatgtttgacgttagtgtcattttatgccttggtattttttacaggcaaagtccaatccactgccgatatctttggtgacgaagaaggagatctgttcaaagaaaaagccgtagcatcgccagaagccactgtgagtcagacagatgaaaataaagcaagagcagaaaaaaaggtgagcaggagggaagacttaacgcaggagcattgatctgcagcattttaataattcatccggaacccagagggaagtactgttccctttcacgttcatattgaagaacttcaaacagaaagtggaaagaacattgcagtgaacacccaaataactgccacccagattgatcagttcttagggttttggcaaacactttatggatgtaaaccttgttacatatctatttttttcctgaactatttgcatgtaagttgtttgaactgtttgctgcatggaactgtttccatgtagtcattgtgacattctacccctaaatatttcattaagcctctcttgaaaagacttccatataagcacaatgccattatcaacagctgtgagactaacagtaattctatagtagaatctaatatctagtctgtattagaattgctccagttgccccagaatgtctttgcaaaatcaccccaacaaatagaatacagatttaaaattatctcgcatatagttcatactgcaatttcctctcttgtccccaaaatgccatttacggcagtgatccccaacctttttggcattagggatataaggagagtgcaacctgcaatctagatccctcgcatgcacagttcacaatagcgtttgccttcctatgagaatctgatgctgccactgatctgacaggaggaggagcttaggcagtaatgcttgctgctcacctcacctcctgctgtgcggcccggcttctaacaggccatggactggtctgcagcccagggttggggacccctgctttatagtatttttttatgttttgattttttttttgttctaagaaactcaggattcggacagtgtgtctgcattgcatttggttgtcatgtctctttggtctccttaatctagagcaacacctcccacatctttttttttttaatatccagccacttgtcttgtagaatgtgtctcgtgaatttgcttgattattttcctatgaatagattcagggtgagaagttttggcaagaatacaagcaggcagggttgtgcacttccagttggatcacctcccaagacacatcaggtccactgtctgcctcattcagacacgtttgtcacttggttgttagggtgcccaccacactgcttcattggaaaggtaccctgttctcttttgccattgctcagttgatctctaaagtgatagttgaacacagtgtgaatacctgttctctcccagccttttactcagtgttttgaaaatccactgatgatcttttcttgactcagttaatctgttagcgggcacaaaccactatttttttaattctatatttcttattagttggcattcttctgaataaagttctttctctccccctccttccccgatttttagtattgctttgggatcatgtattcattcttcagtgtagatgataatccattaccatcattcttcttctttttttttttttttttgtgagacagggtcttgctctgttgcccaggctggagtgtagtggtacaatcacagctcactgcagcctcaacctcctgggttcaagcgattctccagcctcagcctaccaagtagctgggactatatgcgtgcgccaccatgcccggctaattttttgtggagacgggttttgcccatgttggccaaaccatcattctttttgatgctcagattgacctgcatttggccagtgtgtgtgtccccagcagtctttaagcccttctgactgcttgtcctttcactgctgtcctgtacagctggtccctcctctttctacagttttgtctctttgtgtcatgtcctggctgtgaagccctgactttctcctgccgaccacctaaggcccagcattcagaacctgtcaggcccgtcaggcagcctgtctttccatgctgtctctcattgcatatgtcccatctgtgcacccattgacccagactgtgtgtcctgctccctgatacaccagatgtgtcctctgtttgtcttgctgttctcttaacagccccctcagcttgctgcctatcacagcagagactccgtgcgttttctcgattgattgagtaaaccctcttttctgggtatcttacgtgttaatgcttaatttttctttttctttttttcttccccaccccccccccacccccgacaaaggttaccttatcttacagcaaaaatctcaagccctcatcagaaacaaagactcaaaaaggcttattttcagatgaggaggactctgaggtatggaattcttttgcttagttgtgggtattagtctatggatatgacatagaaactatttttgaatcaggtttttctcaatagagttataagactttttgttaagtactccagttctttaaaaattatctctagaggcaaggagtggtggttcatgcctgtaatcccagcactttggtaggccaaggcaggcggatacctgaggtcaggagttggagaccaggctggccaacatgatgaaaccctgtctctattaaaaagacaaaaattagccgggtatggtggtgcgagcctgtaatcccagttactcagaaggctgagataggagattcacttgaacccgggaggcagaagttgcaatgaaccgagatcacaccattgcactccagtctaggcgacagagcgagacttcatctcaaaataaataaatgaataaaaaataatctcttgagagcacaggggctttagaaagcaatatgtttacaatacttttcactttgggttggactgtatttacatttcctgggatgaaaatcctctctctttaggatgctcagattttaaactgttcatgggctcatgatgtgatgaggagcttgcaccagagtggaggtcaccatgctacttcctttattcacattctcactaactagaccgtggcttaatgctgtagcagatgggttctggcatagccatctgtcttgtcgagactgagaccactaacagcctctgggaccctggttcataggttgctttggtccctccaggcaccttagaaccacctctcagaatttcactgcttttcctgagtctctcaggcctaggtcgtcttagatccaattttaagttggccttttaggagatcggagacctgtatgagaaatgtaatgggaaataataagccccttttacagaaaaacatgtggacatggcagaaacttacatgtatttcaagaaactgtgggctctaggttaggctgtcatggttgggctttgcactcacagcaaggatgaacatggaaccctttggaagtatagtgattgcccttgacgtaaagaatacctttgaggctattatttcattgaaggcgagtgtacaaaacatggcaattaaccaaagtccagtcaagtcacaaccctgacccctgagaaacagcatgatggggcctccaccgtcttatgctcatggatcccctgtgtcacccacacctgcacctcggggtctttgcaccggcccctgccactctgaggaatgctgttcccagaatccagctttcttcctcactcttcgatttctctgtgaggcctcgctgatgaaatacacacaacaggaagcctgctagcacataccacgctgtgctcctggtcctctttcctatttcactgtttaccacagcacgtgttgccagggacagtgtatatttgcttattcattgtctctacttcccactaaagtacgtgccatgagggcaggactttgtattccctatttgtatccctaacaccccgtccttaatacctgtgcttggcatgttgtaagccatccagtaattgttgattagacaagaaaaccaaatgtgagcaatttcagtgacttacgagatgttctggttatttgttgctatgaaacaagtaactcaaaaacctagtggttcataacacccatagttttgttgtctcacagttcgagaggttgactgggcttagctaggccgttgtcactgagggtctcttgtgtctgaaggtggctgggctgagggtcagctcactcatatgtctggtacctgggcactggggcccctgggacatctctcactagccctgtgtggctcccagcatgtagtcagggaagccggtcctcttacatactggctcagggctgtaggggagagtcctcagagagagcccgatggaggccatgtcgccttctgtgttccagccttggaagtcaacggtggtccttttccttcatttgttggtcaagatggtcacaatggcccatccaggtttatggggagaggccataggctccccttcttgatggtgggagtgtaaatgtactctcagacttgtgtgaaaaccctaccaaaggctttgccccatgtgtgtcatcatagagtgaatgtttttattggatattgttcagattctgaggcaaggagaagtaaaactaaggcagtctaagtaagagttaaagctttggacccaaaggaatgcgtcctgactcctttctctatatctgaagtgtgaggctgaagcttgccctgtgaagtcattttgggggaacatatttgaggtaacggaagtgtcttttcttgcagtaccaagaaaggtatcagttaagggtccgaaactgtgatgttgacatttgtttttgttctttgctttggtttactttcattttcttagaacagcagaaccctttctcttgccattgtgtaacatgcaggaggggcacgggatgcctggaatcccccacgtggcctcttctatctaaataaacccatgggactccggggagcacaggggaaaaacactgtgtggaggagatctcacttagtgaactcattaggtctatatttaggagtagacagcgaccccataattaaaaaaaaaaaaaaactgtccaaagaggtcttagaaatatcttcttgtcctatttaattgttcggctcttgtgtattgaagtttatcttcccaagggaatagatgtcccattttatgtttctacttcatgtaggtcaacttgcaggtctttctttgcaggataagctgatgttttataacattttgaaaatttcttgatttttatattttttagctattttgagatgaaattatactctttttgcctaggctggagtgcaatggtgggatcttggctcactgcaacctctgccttccaggttcaagcaattctcctgccacagcctcctgagtagctgagataacaggcacccaccaccacacctggctaatctggtatttttacaaaattaatataggctggtcttgaactcctgacctcaggtgatctgcctgccccagcctcccaaaatgctgggattatagacatgagccacagcaccgagctgaaagtttctttagaatctatcaggtcttatcctggtttgcaacgtcatatacctatagttaagctaagtagactagcaaacatttaaaaataaagtttaatttgtatttatttaaaagaaataagtcggccgggtgtggtggctcaagcctgtaatcccagcacttggggaagccgaggcgggcggatcacaaggtcaggagatcgagaccatcctggctaacatggtgaaaccccgtctctactaaaaatacaaaaaaattagccgggcgtggtggcaggcgcctgtagtctcagctactcaggaggcagaggcaggagaatggtgtgaatccgggaggcggagctttcagtgagccgagattgcaccactgcactgcagcctgggcaacagagcgagactctgcctcaaaaaaaagaaaaagaagtaagtcataatcttaggagaggagggtgttactaaataaaatagttgtagctccattaatttgggaatctagcccctgtttctttattgaccctgtctaatctctgattctttagacagtaatgggaagccatgcttatatatttatttttttagcatggtgtaggaaattgattcaaaaacttattcctgccttctgtcattcaggtgggaatacagaagcccctgggctctgcgagcccaccagatcctgtagctctcctcctccttagcgccactgcacacaccctgcacagaccctgaggcctatccctttaaggactctgtctgagccaccttccctctcaggaaagaagcctagacacatggcagctgtcatgtctgagtcacttgtgttttatactgacctgatattttaaaaactgatattcctgttaaccagcaactttaatttcaatccaacaggatttgttttcttctcaaagtgcgagtaacttaaaaggtgcatctctgctgcctggcaagctccccacgtcggtttccctgtttgatgatgaagatgaagaggtaaacattgttattgtaacactagataatttagattaggagaaaacggttgttgatgtaactttctacccagaggctcatatactagcaaaaggtggtagggaagcagtcaggctacctgaagtttatataacaaaaatatttctgtttttatttcagtgacttcttccttatattttcctagctgtgcaatggagaagacattagattcttgacgcagttctttttttttttttttccgagttggagactttctctgtcacccaggctggagtgcagtgatgcgatcttggctcactgtaaccgggttcaggtgattctcctgcctcgacctcccaagtagctgggactacaggtacgcaccaccactcccggctaatttttgtattgttagtagagacagggtttcaccatgttggccaggctagtttcgaactcctgatctcaggtgatccgcctgcctcggcctccctaagtgctaggattacaggtgtgagccaccgtgcctggcttcttgacacagttcttatggagtgaaatctacaggttttatttttagaaatctgcctttgagaaatacaattgaccctttaacagtgtggaggttattttgacttccacattgcagtgaaaaatccatatataacttcttacttcccaaaaacttatctactgatagcttactgttaaccagaagcctcatggataacataaacaggtgattaacatataaatagtataatatctatttatatatttttgtattcctgacatatccagcttttccttattttttttatgatatttctaggccacatggtttgtctgcaagatttttcaaattgttgcaaatgtccaaaaaaattttcaacatattactgagaaaacatttgtgtagaagtggacctgtgcagctcaaacctgtgtcattcagggtgagctgtactttagtctagaggatggatcaacatatacccaatgacctacaagaatgttttggatcaagtggagatacaaaggaggaggcagccatgtcctgaccattgtctttctttcccgtcctggctggagagagcacagtggggaagagaaataagagagaagacaacccaaaccttaactctcatgcagtactgggcggtggtgagctcaaaggctttgccatcagacccctgggttcatatcccagctccaccacttgcaaaccaggaacctggggcaagtaacttaaccttccttaagctcatgtggcttaacagtgagtagggtcactgtggcagctgtaactactagtgtgaagctcttgcagagtgccggcacataataagtgcatagtgaatgtgagctctgtcattagcatccccaatggacaccagctcattattctcctggcctgtcctacattaccgcactctccttaaaggagacttcatccaggaagacactcccttcatccatcttcacattccagggctgttcacctgagtttgtccatcctaactcagactcaggccctctgatgcttttgttccccttatctgaataaaagcaccttaataaatataacttttggggagtgcttgaccacagaagaatttacaaatgccattaaacttagtacaccagcaattttatttagtaagctatttctccactttgtataatctctttgaaactaatgagaaacacaagtcatgccttccctccatcccaggtgtatgtctttctgacctgtaaaggagtggagacagacccccagttctctcctttcagccattgttctggtttctcattcgtggagacaacagtgtgagtttctggctgctgcgggggctcccgtgcccatcgcaggctgtaaccacctgaaatgagcagagaggcacttgcccacagggtgactggatggggctcagtttctccttgtacttcatgatctcatttgcatgttgttctcctgcttatatgcagctgttctgccttcgagttctatggtaatctctttcccttctatgggtgcagtgagaaaaggctgtagtttgggatttactagcattttgcggtttttccccgccagagttgttatttgtatacctgactggagacttacttccttaaagtttgatataggaggacatcctatgttttctgattataaagttgtcttacctttctgccatttgcttttctaggataatctttttgggggtacagctgctaagaagcagacattgtctctacaagctcagagagaagagaaagcaaaagcctccgagctctccaaaaagaaagcatctgccctgttgttcagcagtgatgaggaggtgagctgaggtttctgctaaaaaagaggggattatttcatgggatttaagagttaaagccatcccaagtctttttctacctgttttatatctcgtgatgttcagtcaccaaaggcgatgttcacaagattgtcttttctgaaggaagacatttaatgtaatatattaatttaaagatgaatctcttcaaaatggttaggaataagtatgactcccacacaatagtgtatgctccttcaaatgagttaggccggctaggggggaaatgatttctcagccatcgctagttcatggtcgagtcccttagaacaaatgacagattaaccagagaaaagtgtgcaagtttacgtaagataagttttaccagacacaggagccttcagaaagaaaaactcaagagaaacaggaaatcctgtgtcaattttatgcagtctgatgaagaagcggacagttttgggggagcacgattagatgaaaggggtgtgacctgatgggaataagctggggggagctcagcaaggcctgtgtggtcagatcattctctgcatctttacaaataaggaggctcctttcctctgggaatagggaggactggaatgaaggttttatgacctactccagagagggttagaggattcttctatgtcctgcttcagaggagaagggccagggaaaggtcagagagacctttctgcttctgttttctcaaatgccaaggtgtcatattttgaggtagcatgtcccgtataccccaatggccatatatactagtatcttgttaaatgactactgtgtttcattaatttagaactatagttaggaggagttacctattgaggttaaactcctttttgagggagtcttaacaatatttctgtttgtgatctggatagatactaccaaatcagttagtttagttgctaactcaatcagatttagtagcagggaatcagatttagctgtgcagaaaaagactttaaatatgatgatataaaaaatcctgagtattaaacatcttcctgtgttataataattcctcttttttttaacattgtaggcaagttagtagggggtgaagtggatatataagtcatagatatgttcatgtccttactgaaagcaatttaaaaattctgaagcagattgcaaaaaaaaatgtattaaaagcttatgcggccgggcgtggtagctcacgtctgtaatcccagcactttgagagtctgaggcaggcagatcacttgaggttgggagttcgagaccagcctaaccaacatggagaaaccttgtctctattaaaaatacaaaaaaattagcaggttgtggtggcgcatgcctgtaatcccaactactcaggaggctgaggcaggagaatcacttgaacccaggagatggaggttgtcgtgaaccgagatcacgccattgcactccagcctgggcaacgagcgaaactccgtctcaaaaaaaagcttatgcaacacacatgtgaacaagacacaatgaaaaactgctagtaatccttttactacaaaagtctgagtctggcctttagaaagcgtttaaggaattcccacccagctgtgctcatgccttcacatcaaggaactcccaagcatatataatttgtgttttctactcaaatgtatgaatttatgatagattatccagtttttttcttttaaacattgtcagtgattgttccccctgtagcaacagccagacatcagtgtagttgctcctactagagtattatagtggttcagggaaaataaaaacattacctaaagcttggagcaaaaagacatgcagaagaaagacagccaaggttctagaacaggggcgtccagtcttttggcttccctggcccacactggaagaagaagaattgtcttgggtcacacataaagtgcgctaatactaacaatagctgacgaactaaaaaaataaaaaggttcgtgcataaatcccataatgttttaagaaagtttacagatttgtggtgggccgcattcaaagccatactgggctgtgtgtggcccatgggccacaggttggacaagcttgtcctagaacaaaggctgtcaacttcggctgctcattgggatccatggggaacttaaaagagtgctgacaggccgggcacagtggctcacgcctgtaatcccagcactctgggaggccaaggaggtgggcagatcacctgagattaggagtttgagaccagcctggccaacatggcgaaactctgtctctactaaaaaatacaaaaattatctgggtgttgtggtgcttgcctgtaatcccagctactcaggaggctgaggcaagagaatcacttgaacccgggaggcagaggttgcagtgagccgagaccgcgccactgcactccagcccgggccacagagcaagactctgtctcgaaaaaggaaaaaaaaaaaaaaaaaaaaagaaagagaagacctaacgagtgctgacagtggatcccagctccagagattctgaattaatctggttggggtacagcctcgtcattggagttttgtgatactctctagtggatttcagcgtttagtcactgctaaacattgaggagcacttctcaaaccttcatgtttaggaaatcacccaggcaccctgtgaaatgcaggttctgattcagaaaataggggcggggcctgaaattctgcataatctgctgctggcttgtggactccagtttggtttgcaagactctagactccagagatagagcacttatgcaagtgcttgggagttctttgatttgaaggggtgtgagcatagttgagtagaattcccttaaatgctttctaaaggccacattcagacttgtggtaaaaggattactagcagtttttcattgtgtcttgttcacatgtgtgttgcgtgagtttttacactttttttttcaatctgctttaggatttttaaaattaaaatattcttctctggagttggaagttcttgagttcttggtatttttacatttggcttccttcttatagcctctgtaattaatgttgattccctgaaatagacaagtcgcttgtaatacagtgcagaaccacattgggaagagacatcgtggcaggtgttggaggaggaaatcatgagaagctctgtgaggtcagagagcccagctgtctagatttgagttcaaagaaaagtcttaagcatgagctttcttcaagactgatgcactaagtttaatacttagtttaaatacaacttagtttaacaaatataagtttgattttactccccatgttttataatctaaattgccattggagttttttttcttttttttgagacagagtctcgctctgtcccccaggctggagtgcagtggcacgatctccgttcactgcaagctctgcctcctgggttcactccattctcctgcctcagcctcccaagtagctgggactacaggctcccgccaccacgcccggctaattttcttgtatttttagtagagatggggtttcaccgtgttagcaaggatggtcttgatctgctgatctcgtgattcacccgcctcggcctcccaaagtgctgggattataggtatgagccactgcgcctggcctggagttttaatatatattttatgttttaaggaccagtggaatattcctgcttcacagacccacttagcatctgacagcaggtctaaaggagaacccagggattctgggaccctccagagccaggaggccaaggctgtgaaaaagaccagtctctttgaggaagacaaagaagatgatctttttgccattgccaaggacaggtgagatagtcattggaaggagtccctcactccattaccgtggtaacaagaaaaggaatctgatgcacaatctagttcatcgggtgattgctaatcatggatcacatagtgattgtgccagtgagaatgtctttgcttttcaatggcaccatcttttccctcagtacccggaaatgtttgtctttgtggatccttatctgatttcttccccaatcattattttttaaccatattctttttctttgtttgtcagggatttgagtatcttttgtttgtgatttttctctgggctactctaaagtatgtcaggtttggtcaggattacttaaaagttactttaggccaggcacgttggctcacgcctgtaatcccagcactttgggaggccgaggtgggcagatcacgatgtcaggagttcaagaccagcctggccaatatggtgaaaccctgtctctactaaaaaaatataaaaattagccgggtgtggtggcacgcgcctgtagtcccagctacttgggaggctgaggcagaagaatggcttgaactcgggaggtggaggttgcagtgagctgagatggcaccactgcactccagcctgggcaacggagcaagactccatctcaaaaaaaaaaaaaaaaaagttatttgaatagaaatctgctcagcatttaacacatcctgttaggaggaagttccctgtagagctgtgcagtatcactccaggggctgataacccatagccaacctaggtgcctctccccattaatgctggaactgaagctgctaggatattcagagtgagcgtgggctgtggttggtataacatgctgccagattagcttatgggttcagaattacttccctgcaaatactttttttccttttgaaagcctgacatgattactttgaaattcacctgaatgttattagcagaaagaagtaactgattggacatgtaaatcctatgctttggtgtggttaagcgtcatttgatagattcagaagtacctcaggtttctgtctccaaatactcgaatcttgtcaagcatcaccatttctgcattaggcctctgtaacttgacactcggatgcatctttggtctctgatttagaatataggctctggaaagttgatattaaattctgattctgccagttcctgtctgaataaccttgggcaagttacctaacttccctgtgcctcaatttcctcatttgttaaacaaaaataaaaacagcatttctctcatcggtttgttgggatgatgaggtggaatctaaatgtgaaacgctgagcacaagagctggcacattctgagccctcaggtattgccagttagcatcgtgactgcagggaaatagtacattcctttatttttgttgctctctcctgggacattcttcttcctgtgttgcctggccaccttctttcaaaactaagtgtaagtttcttaagaagccttcccggctgggcgcagtggctcacgcctgtaatcccagcacttggggaggccgaggcaggcagatcacgaggtcaggagttgaagaacagcctgaccaacatggtgaaaccccgtctctactaaaaatacaaaaatgagctgggcgtcgtgtcacgcacctgtaatcccagctactcgggaggctgaggcaggagaattgcttgaacctgggaggcagaggttacagtgagccaagatctcaccactgcactccagcctgggcaacagagagagactccatctcaaaaaaaaaaaaaaaaaaaaaggcctttcctaactttaaacagacaagaaagagaagaaatagggagtagagggcagacatggctccaccttcataccccaacaccctcagctgagcattttctgcactgtatccaggttagcttattcccatgagtgtccactacccccaccccacacaaggtcataaatctggcagtctgaaccccatcttgtttgtgggtcctggttccagccacacaccatacctggctttcaggaatgctttctctgctccagatacatcctacctcctattgttcccgaagttgtctgtcaagttttgtgtatggaaagtaattcataccttcatcagatctcaaaagaagctttacacacacaagaagaagttgaggtgaggatgtggaggaattggaaccctcatacactgctggtgggaacgtaaaatggtgtagtcactttggaaagtagtttggcatttcctcaaaatgttaaacatagagtcaccatatgacataatagtttcattcctatgtatatacataagagaaatgaaattagttgttcatataaaaacttgtacatgagtgtttattgcagccttagtcataacagccgaaagtgtaaacaacccaaatgtccatcaactgatgactggataaacaaaatgtataaccatacgatagactgttcttcagcaataaaaaagaataaagtagtgatgcatcctagaacatgaatgaacctagaaaattttatgttacttgaaagaagctggtcacagaaaaccacatattgtattgttccatttatatgaaatgtatagataaaccacagagacagaaagtagattagtggttgccagggcctgtggggcagggggaatggagagtgatggctcataggcatggcggttctttttggggtcatgataatgttgtgcacttaggttgtagtgatattgcacaactcgatgagtatattaaagaaaacattgaagtatgcactttaaaagagtgaatctggattaagaaaaccattgaagtgtacgcactttaaaagagtgaatctggccaggtgcaacggctcatgcctgtaatcctaactgattgggaggccaagtggaaggatctcttgaggccaggtgtttgagaccagcctgagcaacatagagcgacctcacctctccaaaaaagtaaaaaaattagccaggcatggtgacgtgtgcctgtagtcgtagctacttgagaggctaaggcaggagatcacttgagttcaggaatttgaggctgcagtgggatatgattgtgccattgctctccagcctgggcagtagagtgagaccctgtcttaaaaagtaaaataaatattaaaaatagagtaaatacaaggtgaattttatggaatgtaaattatgtctcgataacgctactaaaaaaaagaaatagaagccaggcacagggtcatttcccagtgctaatcctggccctgtgatctctcttggcaaccgtcttcatgacaattctggaaataggcacgtccgctttgattctttttgtgctataggaagtgggagagaatgttctgcttgggaaggctcaggcatcgtgtgccttgcagcggtaacagctgatgaacctgcactggatagtaacaggaaaggggcaacctgaggcaggagggacagaggctggtgatttgttggagtcagatttcatctatttcaaaggtctttcctgtttgctttcaactgtgtaaggtcaactaatggcttgggtgtttgggtggtaggtggattcctgtaggtgcagtctagaagaaatattgttgttatggtttttgtttttttcatcacacttttccttaatttgaccttttgtttgtttgtgtagccaaaagaagacccagagagtgtcactcctctttgaagacgatgttgatagcggaggctctctgtttggctctcctcccacatctgttcctcctgcaacaaaggtattcttcatctcttagtcccaggaaatgtccttgagtttatgctgcatcagtagtggtacttccccgaatcagctcttcatacctaaccttggaggctgagtcttatggaagaccttatttgcctggtttcagaaagagatcttctgattaatagtattctacagaagaagcacacgtgcaaagccatcattcagtgtcaggtgtaggcacaaggaactgggtctcagaagaggcttgggccccattggcatggaattctgctaacattagactaggccagttaaggcaaaatcattccttttatgagtgtgtgtcgagtactaacactggtcctggtttatattagccagtcagtaaaaaggaaggaaattctcacatgtgctacaaaatgcatgaaccttgaggccgttatactccatcagtggagaaatggtcacacaggtcctagtacagttagactgtggaatactatacagtggtaaaaaaaaacccagggtggagcttattgggatgaaaaacatactgcaggccaaaaaaaaaaaaaaaaaaaaaaagcgtaaacacgtaaacatggtgtaatttaaactttacaaaacaagaaatacacatgaatgcctggaaaccggcctgaaagcatcgatagcacattgttaccagtgattatgtccagggaaaggtatggaatggggaacttcatactctcaatgcctttttaaagcctttttaaggaaggcatttgtgcattactgtggaattagaaataaactccaaacaaaaaatatctaggagatatggaagaagacccttcctgttaaatggagttgctcagcttataccagaagctctcagccctgggccagcatgctgcccaccctgggccccaggctccctgctgctgcttctacggggctcctgagcctttccttgggtgctctgtacttacatctccccctttaaggacatccagtggttgtacaattaaaggagtcaggagatctgattggtttttctttgtaaattataaataaactactctggaggataactgagcaataaattaatgaattttggagcctctggagctgtaaaacttctttcaacctatggtaattatgattgttaaataaaacaaaaggtcaagacacacaacttaagtagctgaatagcctacacgtttttgattatttgtgaaatataatcatctttagacaatagtaaataaaagatatttcttgtttacagatatttcagtgtaagttaattgtgacttggttgtaagcctatgttgaccaaaaggttaaaccacaggcaggagaacttaaagaaatgtaatgtgagttttgttttgagccaagcttgagaactactagcccagtaaagagactccacacaaactgagaatgcgtcccagagtgggccacacgagacacagcatttatacatttctgttatatagaaaatgggaaaagggggcagtgaagcaacggtgactttcttaattcagattggtgctcaatgacattgaatataagataaagtaaatatgtggttaatgtattttcctcattagccttttaccctaatgagtacataggggtcgcagttgcagggtcaggagagggatggttgattttgtgctgcctttgtgcttcatccaataggcaggttgtaatcggtgcctgtcagtgtgatatttgacagactctggccttgcaggtgaggttcagctttcgttcataggcccggtttctattacccatatggccaagatgcagccattttagacaatttttttttcttcagactttccttattttctgacacctatcaagaaagtaaatttgaccaggcacggtggctcacgcctgtaatcccaacactttgggaggctgaggtgggtggatcacctgaggtcagaagtttaggaccagcctggccaacatggtggaaccccatctctattaaaaatacaaaaattagccaggcatggtggtgcacgcctgtgatcccagctactagggaggctggggcaggagaatcgcttgaacctgagagatggattttgcagtgagctgaggttgtgccagtgcactccagcctgggcaacagagtgagactccatctcaaaaaaaaaaaaaagaaagaaaaaaacaggaagtaaacttcatgacaaggatgagcttgtcttcaagaagattaaaactggtactttgggtagcattttctgtggtttaaggaccttagttatatatgaaggaagaatatgatttgccatacttaagtctctttttgtctcccctatcaactatttgcattgaattttttttttttttttttttgagacggagtcttgctctttcgtccaggctggagtgcagtggcgcatctcggctcactgcaagctccgcctcccgggttcacgccattctgcctcagcctccctagtagctgggactacaggcacccaccaccatgcccgactaattttttgtatttctttagtagagacggggtttcactttgttagccaggatggtctcgatctcctgatctcatgatccgcccaccttggcctctcaaagtgcttggattacaggtgtgagccaccgtgcccggcctgcactgaatttttatgtagttttcagtgagtccaggatgttccacaaaagccttttcctttgatcacttcagtgttgccttatctcttctgaaattctttatgccttccagtgttcttttatgtcaagttcaatggttttgcactttacttatctcttcctaactaaaaatccccttgctctcttctttcttcattcatcacattttaaaatcatgattagcaatgtccttccttagtttcccaaatctgccttcctaacttgatttaggcattgcctcaaagcacacttcctcgtgtcatatggtatgatttgtatctgtactatactataatagagctttagttttttctcaagcacttgttgataagtcacttgctgcaaaaatgccatgaattccaggaaagtcacaaacctcagtttcctagtccccaaatccctgcctccctgataaggaagagatgagaaatgggctgaagtgcttgcagacttgtattgaacactgagttggtataaaacactgggactgtccatgaaaatatagtgtatagtcctttcagatgaacagacaaacagatgtgtgctagctgttatataagttaggaagaaagtcaaggaagggtcaagtagagagataaatattatgcttattcaacaaagcaactgacacttaactgaagaggacagagaccgtgggtgacatctgcgtgggggccctgcttgaaggatggggaggatttgcacctacagacatcgagggcagcgtggcatggaagtttgaaagtttgcagcgaccttaaggaacagcagggaaaggaggagatgcatatgagtagagggatagaatggggtatctgctgagtgtcatttgcttcatgcaaggagtgctggtttgggttgggagaggacctgatccagcaggtgttttgttttagcaagacaacgctggataatgtcttctagttgaaatataagaggagtgaggcagagagagagactcatgatcgtctggtggcagagataaggatctgagggagggaggcatgggggttgacagacacaagtagacagatacaggtgatatggtggcgtgaagtgtcctgtccacaagtcccgggtggtggtgtttgttgcttctcccttttggtgctaccttcactatcctgtcctctcttccttgatcacatttagctgaagccctaagaggatggtttgggcttgttctgtatatggccatgctggtcagacacacttttttattgttgtggatgtcatgtactcttcttttggtagaaaaaagagactgtctctgaggcaccacctttgctgttcagcgatgaagaagagaaggaggcacaacttggagtgaagtctgtggataagaaggttgagagtgccaaggagtcattaaaatttgggagaactgatgtggctgagtcagaaaaggtggactttttttcttgtatacttgaatgcatttgtctctcgtatgttgtttcaaacacacccaaccccttaagttttttgaccacagaaaataaatggcccatttgtagacagatttgaaaacatagacaagcaggctgtgtccccacagtgcaggaagcctctgcagggcctttcctcccggcccttctccaagacatgtgcgcactgtggtgtgcctgctcctgtctctgtggttactgtcacgtcatggcatctttgctttctaacttgttctcttctgtgcagtgttcctgttacccttggtcctcctttggtccccaagtgcacttgaatttaaatgtcagttttaaggagattttagtttagcatccttttacttttagatgatattggcaaggattacagagtagagtgaaatttctactctttctaaaacactagctttcaagtcctggacggtctgccgtctcttgcaggaggcctgtgggtagttctgctggccacacctgggcatccagctttgtggttgccttcagtctctatatgcctcttttctttctctaacttttcttatacgctgtgtgtccagctgcttaggtctaagatctcccagggcctgtgtgaagagcgttgcatttgcatttgctgctgaggctccttggagctacagtgatacaagcatttcatttgtacctgtgttcctgtgtgaaattctcttcctagtggctgtgtgtggaccccagtcctatcccagtcctggtccacacttgactctgactggttgctgtactgccctctccctgagtgtaagccccttgcggactaggcccagtttgttttgctcaccatcatatctgtagtactggcatattaccttgcacacagtaggcactatgttataaactttgtatttctttaaagaagcatttttttaatagtttgagtactctgaaatcgggatgtacctcataatcaatggtatcttacctgaaatgtgccatttgttgaatgaataaatactgcattttagaattatttcagagattcttcttcaattgcctatacagtgtaagccttttacaatttgagggtctgattttcctgattagatttcccccttggggcttatgtattagttaaatgctacgaattcatggtccactcccaatgattggcacttgtattggttatctttgacacttagaagttcttcctagttcatgagcaaccagtgtgcatcaggattatagccgtcctatcacttgataggagagagggacccatggtcttaatgcttggaaaagttatctttggctacggatgattgtacaagactgtctcttggagcagccaatcaagaattgacctcagtgttttgttacttgggcacagatgtgattcactgtgccctgagtcatgcaaatgtggcagttactgaattaacgagaagcttggcaggctccatgataggatttgtatttccaggtgttacttattttttccccctattattttcattttcaggaaggacttttgactagatctgctcaggaaacagtcaagcattctgatttattttcttcatcatccccatgggacaaaggaaccaagcctagaaccaaaactgttcttagcttgtttgatgaggaagaggataaaatggaagatcaaaacattatccaggctccacagaaagaagtaggaaaggtaagcaaaaagcagtagtggttcaagtctctggatgagataaaagactctcatctcatggttgtcattctgtcatgtgagtttctgaaggaatcttaaccttcaatgtagtgtgttaatgattctgtgcagtcatttagatatttgggaatcttaatcaggaactcttacctcaagtagcagtgttaggataggggattagaatttcacccccctcttctgggatttacagaccttgttgttccttctagcaaaactttgccccttggccagttgtgggatgtaaacagcaggaaagggaagttaggctggagctgtacagttaagtatttctaacattcagtttaagaaaaagtgttgtagatgaacctttcatactgatcaggtgtcagcaaactatttctataaaggaccatataatgactattttagcttttgcagcctatttgggctctgtcataactgcctagctctgccattggcagcatgaaaacagccctaggaaacatgaagatggatgggcatgactgtgttccagtaagttttattaataaaaataggtgatggtcagctgggcatggtggctcacacctgtaatcccagcactttaggaggccaaggtgggtggatcacaaggtcaagagatcgagaccatcctggccaacataatgaaaccctgtttctactaaaaatacaagaaatagcttggcgtgatgacgcttgcctgtaatcccagctacttgggaggctgaggcaggagaattgcttgaaccaggaagtcagaggttgtagtgagccgagatcgcaccactgcactccagtgtggcaacagaacgagactccatctcaaaaaaaaaaaaaaaaaaatagatgatggtcattctgtgaggttagtatgaccctgatattaaaactagacagcgacatcaccagaaagctagatatcctttatgaatgtagaggccaaaatcctcaacaaaaatactactaaacccaattcagcaaaatataaaaaggattgcacattatgagaagtgagatttacccctggaatgcaaggttggttcaacatctaaaattagttgatataatgcactgtatcaataaaatacagaattaaaaggcgcatgatcatctcaacagatgcagaaaaagcttttaataaaatccaaaccttttcatggtaaagcactcaattaggcataggaggaagcttaatgaacttgataaaggacatctatgaaatccctcagctgacatcatacttaatggtgaaagactgcatgcttttcaaccctaacatcatgaacaacacaacaatgtccactcttggtaattctaatcaaccttgtactggggattctaagcaagccatgtaggtgagaaaatgaaataaaaggcattcagattggaaaggaaaaagtgaaatgaagcaatctgtatttgcagatggcatgatcttttatatagaaagtcttaaggaatctgcaaaaaacatccattggaaataaagtcattaagattgaaggatgtaagatcaatatgtgaaaaccaattgtagttctgtaagctagtaatgaacatttactaacttacaaaagttactactagtaactttcttttttttttttttttgcaatggagtttcactcttgtcccccaggctggattgaaatggcacaatcttggctcactgcaacctttgcctcccgggttcaagcgattctcctgcctcagcctcctgagtagctgggattataggcacccaccaccatgcccagctattttttgtatttttagtagagacagggtttcaccgtgttggccacgctgaccttgaactcttgacctcaggtgatccacctgccttagcctcccgaagtgctgggattacaggcatgagccactgcacccaacctactagtagtaactttcataagcaattaccagcttatgaatgaaattaagaaatcagtttcttttatagtaataccaagaagggtaaaatacttaggagtaaatttagcaaaagaagtacaagacttgtaaactaaaatctacaaaacattgaaagaaattaaagacctaaaattgatggaaagacatcttgtgtttatggaccagaaaccttaatattggtaaggtggcaatacttccttcccaaattgatttattgtaatctctatcaaaattccagcttgctttttgcagaaatggacaagctgatcctaaaatttttatggaactgtaagagaccaagaatagccaacagtcttgaaaaggaagaacaaagttagaagactcacacttcctgatttcaaaacttactttaagacaggatggtattggcataaggttaaaatatatagatcagtgaagtagaattgagagtctagaaataaaccctcacatttacagtcagttgcttaaggtgctaagatatttcagtggggacagaatagtcttcagcagatgtgccaggatgctgattatctacatgcaaagggatgaagttggacccattaataaataaactcagatccaatgtaagatccaaatgtaagaactaaaactgtacaactcctagaatctagagagtatgtgagtaaattatcatgaccttggattaggcaaagccttcttagataagacaccaaaagcacaagtgacaaaaatagctaaattggactttatttaaatgaaaaacattgtgcttcaaagggcaccatctggaaagtcaaacgaccacccacaaaatgggagaaaagatttacagatcatgtatttgataaaggactcagatccagaatatgtaaaagacttataagtcaataataaaaagacaaatagcccagttgaaagaagggataggccaggcgtcgtggctcatgcctgtaatcccagcactttgggagaccaggacgggaggattgctttaggctgggagttcaagaccagcctgggcaacatagcaagatcctgtctctacaaaaaattttaaaaattagccaggcctggttgcgtgctcctatagttctatctccttgggaagttgaggcagaagagtcctttgagcccaggagttcaaggctgtagtgggctgtgatcacaccattgcactcaggctgagtgacagaacgagaccctgtctgaaaaaaaataggtaagacagacatctgaatagagattttactgaagaagatagacaaatggccaaaaaggatatagaaagatgctcagcatcagggaagccaaaaccacagtgacataccacttcatacccgggaagaggaccataataaaaaaaaaaaaaaaaagggaagtaacgagtgttggtaaggatgtggataaatggaaattctcattccttgctgctgcaagtgtggaacagtacaaccactttggagaacagtttgctgttcttcaaattcttataacataaagctaccacacaatccggaattttattcctgggtacatatccaagagaaataaaaacatgttcacacaaaacttgaatatgattgctcccagcagcattattcataatagccaaaagatggaaacaatggctaaacataatatagtatatccatacaatggaatattatttggtaataaaaaaggcaaagtactgatacatgctgccacatggatgaaccttgaaaacattctaaataaaataagccagtcatgaaagaccacatattatgtgattccatttatatgaaatgtccagaataggcatatcaatggagacagaaagtagattagtagttactgggggctgggagtagcagtgagcaggaatggataattactgctaatggtttggggtttcttttgggggtgatgagaatattctaaacttagattgtggtagtggatacacagatctgaatataccaaaaaatcattacattttatacgtaaatgggtagattttatggtatatgaatttgatctcaatggtgatgttatgcaaaccaggttggcaggtcatagattgccaatcctttttatagatctaaccaaagaaatagtctatgtttatttctacaaaaaatgttatatgaatttttttgttataccaatactataagcttatttataaatgagagctgcacacagtgaatatgattaatttgatatattttctcccagtctcttactgtgtatggttttgtaatatttttccacagttgtgaaatatttaacattacttgctgtgttaaactcatttttatatgtaacaataataattattgttaatgtgatttattttgttagaagtaagtttttcattagtttttttggtttttttgttttgttttgttttgttttgagatggagtcctactgtgttgcccaggctggagtgcagtggcatgatctcggcccactgcagcctctgcctcccaggttcaaggattctcccacctcagcctcccaagtagctggaaccacaggcacacgccaccacacccggctgatctttgtatttttagtagaggtggggtttcaccacattggccaggctggtctcgaactcctggcctctggtaatccacccgccttggcctcccaaagtgctgggattacaggcatgagccaccatgcctggcctttttgttaagttttaatctgtggctgtgataaggaaatagggatgaattttagaatgtcaggtctggagcattatattatcaaaccaataatgttgatggtaacttttaaatgttagatatctagtaaacaaaaaagggactcactcggggtctgaaagtagggcagaagtgatggacagccataggaaggcttgtggtcgcacctgtgccaggtctttggcctgcagtgcttacaggtgagggacacatacttgaccactctgtgtagtttgtgcttgagtcagctgctgtctcttcttccctttggaaatgagatgaagagaattcattcagttgtatgttttttaccttcaaaatgtttctcattatggaactaatggattgcttttctaataaaaaatttagatactatacgaagtttatataatatatataacctggaaagattatctctaaagcttgtgcatatatatatatatgtgtgtgtgtgtatatatatatatatatatatatatatatatatatatacacatatatatatatatatatacacacacatatatatatatatgtaaactttgtatttataaatatattttctggtatttttggaagcgccatagcattccattttgtcaatgtttcattcccctactgagtggcttttaggctgtggccagccttttgctaatataatacagctgcaggggacatctttgttgtgtccatctttacatatgtaacttccttgagataagttcttacagctctaatcacacatgaccttccctcctgttcccagggctgcgatcctgatgcccaccccaagagcacaggtgtcttccaggatgaagagctgcttttcagccacaagctccaaaaggacaatgacccagatgttgacctttttgctggcaccaaaaaaaccaaggtcagttccaaatggttccccacagtatgacttgttattgtattgggtgctgtctcaacagctcacctagttctctttgtaaattgttttgcttttggatattgaacttgggtcttgtttattctagctgttagagccaagtgttgggagcctgtttggggatgatgaagatgatgatcttttcagctctgccaagtcccagcctttggtaccagccttttgttctcaatactgggttgtgtgggaaagattctgggaaaggaaactaacgtccagttagatgattaaggaaaatcctaggagagtcgtgctgcttcctgctaaatgaatggcaaataacatgccgaggggagcgtgtgtggaggatgcaatgcttagtttctgttgttcctcatcttatgttccctatactaacattaaaacattaataatccaggctctctgactgtactacacatctgtgtgatgtttaaatggttgattgaaagaccattgcatacactggggtggctaaatattcgtgcctttcaggtgcaaagctttgaatctgagttttagcctttctatgtcattttctcccccagccccagtaggtttttgtaagtactctgttttctttttatcatagagaggactcctgtgacagccacagtcttcagaatgctatttctgaaatgctacctttgagttggttcagccctcatttgagaaagtatttttaagactcagaagccaggattgttttttgcattatgatttttccttaaaacttctaagatatttgatgcctttttggtattttttttcttttgaaggtacaagagaaaaagagagtagtgaaaaaagaccactctgttaactctttcaaaaaccagaaacatcctgaatccattcaaggtagtaaagaaaaaggcatatggaagccggaaacacctcaggttagaaatcctctttaaggattttcagctcttgtttgcatcccagtacagagaaattccattatgcagacccacagttatttagacttgtctgcattaaggaggaaacagcaaccagggctacagctttgtcttcactgcacttcccccgagtcatctcccctctcctcactccacacgccagagtttcatgaatctatactttaatagttagtgttttttgatgccatgccagatttgactctgaagtggagttaaggtaggatgaagaatcttcttcccactaaagaatttatttctccctctggatttccttggaatagaattaaaatagaaataaatataaattacatctgatttcctgcctgctctcagtgttgcctctcccgaggtcattgctgttgggccgtactctgcagcagtcttctcagaacgctgtggagctcctcctgggaacagcccaggactggagagcgagtgacagttccacgtgcaggtgtcccagggtgtctcactgaagccttagtgtcctgagccgtaaacctgaggcacttggacgaacacatcaccactgacccttcctggggctcagatcttttgcttttagagccagtgcattaggctatggttgaatttttgtgtgctccttgaaatttctatttgataaccaacatggtaattttgcctgctggtcagttttaggtgctctgataaactgtgactcttgggaatcttactcatcttgtattccttgactccatatctgatctggcagctttccacttatgtgacagaggaggaggcatacgtgaagtagtgctagtgaaacatcaggccccaggagagatttgaatgcctttcccattaaagagctacagaaagtgacagttttgctccatcacagatttatttacaggcataagaaacacttgtctttctgtttcccaaatggatttttaactggatgtaatcttacacaggactcatcaggtctcgctccatttaaaaccaaagaaccatccactcggatcgggaagatacaagtaattaaaacactggaatcttcattgcctgccctgtggcatctataaacttttttgggtttcctactcttgtcagctgctgccaaacatcttctcatctcttcccccgcctcccctcccctgcacctagttgttgtctcctgtgtgctgcgtctttaacatctattctttgagcccagtggtgggcataggtgtaagacgctctgttttaattctgagactagattgggcgattttcctacgtttctctactcctctcgtattatacattatgtgtaccgaatcttgtcatgtgtcacaataaagataatagactgctgtgttgaagaacaaatacagagtttcatttttcttctttaggcaaatttagcgatcaacccagcggccttgctgcccacagcggcttcccagatctctgaagtaaagcctgttttgccagaattggcttttccttcatctgaacacagaaggagccacggtctggaaagtgtgcctgtccttcccgggagtggggaggccggtgtgagttttgatcttccagctcaggcagacaccttacacagtgcaaacaaggtgatgaaaccatctttgcttccttgctctcttcttttaaccagaacatgcatatgcttctttctagtttatcagttgcatacacagcagtctttgactctccttttgaaggaggtgcctcatccttccttcagccgctcccccctccattctccccacccccctcatcctgcacctgcttttccatggcctgcatttggtacatttgcattctgctcagtagccacagtaacgtctcaccactttggctggtgtctgacacctgcaggtttccagcactgccacctgggggtcttctaaccacagagcagatcatgcccctcctgctggcgcttcctcactactccaaggagagcattcgggctcctgggtttggtatgaaacccctttgcaatcggtgccagcccatgtgtgcagcttcctcactagtcacttcacactttccagcctgactccaggcacaccaggtgccactccctgaacacacatggtctgttctgctgctgcccaaggctcctgctgcctcctcaccaggaatgcccctctctgtccacagctgtgcttccacatccccacttctgtcactgtgccctgcactccctgcaccaagttcccacagcagcgacactgtttcatgggatctcctcaatggactgtgaactctttgaagttttcctttcattgtagttgggtttcttgtttctatccagtctcccttctctagaaagctttaactgatctgcaagtaagtgacaggacacagaatgacctaccctgacaaatagattcatttcaaatgtttgcaaacctgtttccttgtgcaaaacaaaacagccttccttttaacgacaattttcattggctttttttttattaagtttaaattggcaactaaaattgtgacattcccctgaagttgacaacacaatcatactttgcccagagtagattgtagcttctcaaaattctacttgattgtatattttggaaactatcataaactgcatcattgctactaagtgattcatgttttgagattatatgaaaagttctgatttctaagccatatttcttatgtggaatatttaacatttgaattcaatgtttattgacttgaagaaaacagcaccttagattacctctctttattgtgtcatgtttctccccgctcctggagcctgaatttagactagccccctaacaaaggttagtaccagaattccccgattctttcttgttttgaaagatacccacgtttctgttgagggtagagtaggggccaagggaggggttgtgagacacagagagccaacatgcctactttccaggtttccagcaacagatgaaactttttgtgtgaaactgaactgaaactgccctgaaaagattaaaaaatggagaactctaaaggattaagaatgacttagtcttggagtactaggagctattaaactccttccttggaaatcattaagaaataacctcttctatgttcttagataatatcttcattgaagtagaccagataaccttacaatattttgagtcactgattctttgccatggtagctttgaacactttattttatcgtcagatcaatgtatgtttttttgccgttgcagagccgtgtcaagatgagagggaagcgtagaccgcagacccgtgcagctaggcggctggctgctcaggagtccagcgaggctgaggacatgagcgtccccagaggacccattgcacagtgggctgatggcgccatttccccaaatggccatcggccacagctcagagcagccagtggagaagacagcactgaggaggccctggcagctgccgctgcaccttgggaaggtggtcctgtgcctggagtggacacaagcccctttgcaaagtctctgggtcattccagaggggaggctgacctttttgattctggggacattttttccacgggcactggatctcagtccgtggagagaacaaaacccaaggcaaagatagcagagaatcctgccaacccaccagtgggtggtaaagcaaagagccccatgtttcctgctctaggcgaggccagcagtgatgatgatctctttcagtctgctaaaccaaaaccagcaaagaaaacaaatccctttcctctcctggaagatgaggatgacctctttacagatcagaaagtcaagaagaatgagacaaaatccagtagtcagcaggatgtcatattaacaacacaagatatttttgaggtaataggacttaacacgtttttgtgtctgttctaagttaaggaaggtatctgattggcttatttgagccatagattatgtctagcttgttgcgtgcataccccatagccacttgcttagtaattataattaggctcttttattaataagtctaacattgattcagaagtggttttttgttttgttgcatgtagaatgtatttcttggctggccatgatcattgatactgatcttggtttctctagtttttacagtttttttatttttatagaatattgttgtaatcagcttcctgggcatgccactcggtgacatggcatacagctccactggtccagcttgggagtttaacctctggttctggggacattggccctggctggagctgacaatgtagtgcatgcaggcaataagactttcagtggcatttgctcagcagatgtttattgagcacctggggactgcaggcacaaggtgaactcagagaagtgctaggctcctcagagctctctgggaagataatcaaatacaaacagggcaatggataattaagatgttttcaaatagtactaagtgtcatgaagaaagtaacctggggcagagtggtgggtagggctgggaggtgctcctttaggcaggactggtagagaaggtgtcactgcagtggcggcatttgagccggggtgagatgcgcgggccaagctgtgcagagatctggggtagtgcatcccaggcagagtgggcagtctcgaggccgttccacacaccctggccaattgcatttccatagcttgttgacgtgtttgagtttaaaaagaaaaattgatttaacattgttttgtatgtatttttggcttaacaaggatgatatatttgctacggaagcaattaaaccctctcagaaaaccagagagaaggagaaaacattggaatctaatttatttgatgataacattgatatctttgctgacttaactgtaaaaccaaaagaaaagtccaaaaagaaagtggaagccaagtctatatttgatgatgatatgggtaagtttggttttctacatctgacctagagaattcttacctttccatcacttggtatttttcctgctaccttttcttggcccttttctggaaaatgcaccccagcgggttcacttcagtgtaatcctgagttaggctgaagataggtaagagatggactaattattttagtgaagtaactctttcctatgatagtcatcaaagaatttgaaggcacccagagtttgatgtttaagtataatttaactttgatctcagtgcacctcaccaatcatctgtgacacaccctgatgttatgtaaggaggtttgatcagaaatgacctcacgtgctaaagtaggctgaggggactgccttgggtgtgatgtggttggttgagtcagagctccagatggacagggagtgtccatggttctgtgcgagaagagagcaagtctagacctgggtgtaggctctacctcaggcgttgcatttcactgaggtctttggtgtttgggaacaagcttgtcttccttatatggcacaacttctgctttattagtagacaaggcaaatgcccgagaaccctaaatattggacttttgataaatcctgtgggctgagccacatacacatttcctactccccccgtcaatctagacctttagactaactgggagacagctggtgctgcagagccacacactggctctgtgcctccagcaagccgtatgctctgtctcccctgcttcccaccacatggaatgcagaagggaactcattcattattttaaatacaaaaaaagtaatacatgcttattgtaatagattcatgcaattcagaaaatgtaaaaagtgaataacccctagaggtaatagtaacagtttggtatgtatcctttcagacacagtgatattaatatatgtttgtgtacacatcaatatatacccacctttttaaaaagtaagaatatatttccctattctgctctgtcttttagttacttaatgtcttttcatgtcagtacgcagagatctccttccttgttttcagtgctgtgcacgatttctttatatttagccattagcctgttgacggcaatctcgattgtttctgttttctttattacaaataatgctgtggtctttaccatttgtgtacacctaactttatgtatacatgctaaaatcatggttggataaaaccctagcagtaacattactgggtaattaccataattagataagacaagcttttgagtcagtgaaacactaaacgaatgcagtgacggaggcttacagtcttacatcgagatgcctcaaatcagtgcatttattctgaaagaaaacaggtgggtcctatattggatttccctttgcatatttttattgctcttttaaaacccagtatgaaaagaatatctaaataagtccattgtccctgatggtaggggcgtgggctggtttggagatcaagttacccttcccttttttctgtcctgcacacgcacatacatacacttttgtagctgaagaaattgtgctccaagagaaacctgtgtgtgatcataaaatttaatgagtaacaaacacagaaccagaatctaagaggcttgagttctaggttagtgttttagggtactccatgctgttacgagagctgggtctttggtggtttgcttgcatgtgtcttaaaagtacctttctccacccctcttcagcaactgtttttcttttttctttctaaagatgacatcttctccactggtatccaggctaagacaaccaaaccaaaaagccgatctgcacaggccgcacctgaaccaagatttgaacacaaggtgtccaacatctttgatgatcccctgaatgcctttggaggccagtagagcacacagggtatccacatgttaccctgcagctacattgttgagttagtgatgatattgtatatgctcatggtcttaactggattacaaaaagcaaatactagaacagctagctcatcttttacccaatgtacttagtatttttctgcactggtttaatcatgcttaatactacaaaacaaaaataaatatttcacagtggttggtttgttttgtttttaaaccacagtttgatttagttagccttgctggggccataatatgcttcagggtgtgtaaaagaagaaatctctttgtggctttcatgggcagggaatctcagagatagcaaatgccacctgaccagaagtctttgttatatggatgggaaccctaacttagggcttgggcaggggaaagagaaagaagatgagagattatacttcatgagtcttagcaatatgggagcaggttttcactgaattctgagggtgcctctgcatgtcctccaaggcaaagtttggcaaactgtggcccccccactgtcatattttgttaataaaattttattggaacacaatcacattcatttgtttacttactgtctattgctgctctcaccctacctccaatgtaagagttgagtgattatgacagagactggatggctcacagagcctcagatgttttctatctgcccctttatatacagtttgctgaccattgctctaaggcatccttttccatccttgtcttgtggaagcagcagaatgaacctaggtaatagccgggggaagtgctgaagatggaaatgtcagcctctagagcagcactgccccatagaactccacaggaatgaaaatgttctttatctgtatcgacaaaggcagtagccactagccacctggatggctgaccccattctaatctgtgttttttggtgctctgtcgtcttgctgctgactatgcagcctgtcaccacagcacagtcttgtaggccgcccaggttggtctcagcgatcgtggagctacttacttcttccttgggcactgtaagatcggaaggggaattactcatacccagagtcaaacattttgtacggcttccacaggtcaaccatttgcccaagtctgctgtgagagtgacgtgataacagataagggcacttgctagttggccactcctttcccctattcattttatgcatcttccttctgtccttaggttgagatctccgagtcgctgttgtcaggcagactgctgtcctccagattcaggcctgtgggtctggggagccctggttggtcttggaggagcaagggctgcgcaggtgacttggtggcctcaagtgtataggtacctggatggtgcgaggagatgctggctctgaaatatttcctaatcccgcttgcggatcaactgccgactagcgtttaggttacagacatattagatggttgatgtgattctgtagctcgtatttagaactttagggatgttttcacatatcagtaaatgaagatctatgtcaacattttttttttttttttgagacggagtctcgctctgtcacccaggctggagtgcggtggcgtgatcccggctcactgcaaccaccgcctcctgggttcatgccattctcctgcctcagcctcccgagtagctgggactacaggcgcccaccagcacgcccggctaattttttgtatttttagtagagacaggttttcaccatgttagccaggatggtcttgatctcctgatcttgtgatctgcccgccttggcctcccaaggtgctgggattacaggcgtgagccactgcgcccagcctatgtcaacatttctaatggtagcttcacattctggatatctttatgttggggaaaaagttttaaaggtaactgctcttctgtagcaaagcttttttagagcagaggatggagcaaattctgagttactgaaattacgtattcagtgctattgccttgtttaccttccatttcatctttggagttgtgtttttagaactttttcagaagggatgagataaatgctttgggaatttatttagaaatctttttggtgtcattactcttaagagctagatatattttttaattgtaaaaaattatggaaatacttttttctctacctgctcccatttttttttttttttttaaagacagggtctggttgtgttgcctaggctggggtgcagtggcataatcatagcttgctgcacctttgaactccagggctccagtgatcctcccaccttagcctcctgaatggctgggactacaggtgtgtgccatcatgcccagctaatttttaaaaaaaaatttttgtagagacaagggtctgttgcccaggctggtctcaaccttcttacctcaagtgattctcccaccttggcctcctgaattgctggaattacaggcatgagccacaatggccagcttctttctgttttctttgtttcctcttccccttctgttttcttcctttttttttttttaagctgttctcgcatcattttccatcccatctttaagtcttcattgccacctcattttccaagatcatgagtcccacagtatgctcagctaagcatgaccacacaccatttcaagaagccgttcatggacccagcttttattactggctgggtctttgttctcctgctgcagcttccatttgctcctcagctaccctctaggcatccagtctggcttaaccagatttcatggcctcattttgtcctctgctacagtgatttctactcctgaggagaagcataactatcttctagagggaaacattttagcttttggttatcaaccttggttcttttgggatattggaaattaccccattgactggacccagacttacggtggaagttccagcacaattaatgctgaacggggttatgctttttcttctggcatatagttgaattatccattctcattataggtgaaggacttccaaatctgtttgttatcttctaccctcccccagcctattattttcagggtctcactatggaagaacactgtggtgaaggaaacaatccatattccttaggcagttatagtcactcatgtctttatttctgtcatgtgcattttgcagtcctgacacctgacttctgttgctagagctgcacctgtgtaggtacgagtactgttggcttcggggatacacacgctggcaactctataggacagtcttatttgatatagcataagtatgtttttaagaattcatgttatccaaaattataaaagcagttgtttgaatgagtgaaagaaagggggttaaggttagagagctccatacaaagtcatatataagcaatgcagctttttaatttagcttttatttaagagcaatgaccctttaccactatcaccagcagtattattagcctggtaccttgtattactcttaatacccatcattttgaaatatggtgcaacgacactcaaatgagctgcactacaagaaacaactttcctttctgtaatgccctccctttaggatcactagaagtctgtacaatgcaatgcagattcccgaattaatgatctttcctattagtgtaattaaaaactcatattatagcagattcctgtatgtgcatgtatgttatgagttggataaacgttggtggacttcatttggagtgaatcagaatgggattcctgtgagaagccaacatccctctaaacaaacttttggagcatgatatggcttggatgttttgtcccctccaaatctcatgttgaaatgtgacccccagtgttggaggtgggcctagtgggaggtgtttggatcatgggggtggatcctcatgaatgtcttggtgctgtccttgtggtaatgaatgagttctcactctgagttcacatgagatctggtttaaaagaacctgggggccgggcaccgtggctcacacctgtaatctcagcactgcgggaggccgaggctggtggatcacgaggtcaggagatggagaccatcctggccaacatctagaaaccccatctctactaaaaatacaaaaattagccaggtgtggtggcacgtatctgtagtcccagctactcgggaggctgaggcaagagaattgcttgaacccaggaggcagaggttgcagtgagctgagatcgtgccactgcattccagcctgggcgacaagaggaagactctgtctcaaaacaaacaaacaaacaaaaaacaacctcacacgtccttcctctctctctctcttgttctctcaccatgtaacatgctggctcctctcctctaccatgattgtaaacttcctgaggccctcactggaagcagataacagcattataccccttgtacagtctacagaaccatgagccaaaataaacctcttttgtttataaattgcccagtgtcaggtattcctttatagcaacacaaacagctaacacaggataaccaaatagttattaatgtctaaaacttggataataccttacctatagcacaggtttattctgaggatcaattgaaagacaaaaatatctgttctttccttgaacaaagctttaatgagtaccaatatgtgcaaaacactgtgctaggtggtagagatcagatgtgctcccttcagtttagtaaaaaatgaaattgttagggaccgggtgcggtggctcatgcctgtaatcccagcactttgggaggctgaggcgggtggatcacgaggtcaggagatcgagaccatcctggctaacacagtgaagccctgtctcttaaaaatataaaaaattagccaggcgtggtggcaggtgcctgtagtcccagctattcaggaggctgaggcaggagaatggcatgaacccaggaggcggagcttgcagtgagtcgagatcatgccactgcactccagtctgggcgacagagtgagactctgtctcaaaaaaataataaaaataaaataaaataaagaaattgttatgggtgcaatatatgatgtaggtagtagtgtaaagggggtaggtataaaagctttgtggaatagttgatattggagctgaatgttgaaaggtgattaggtgcttgtcaggtaaccatgtgtgcacaagacagtaagtagagcagagcaggagcaacaatatagaagctgatgtgttctgaagctgcagatgcagatgattagaggatagaagtaccagagatgttgcaagatgaggtgaggtagtagatgggtaaaatggggccggaatatgaggtgcataatcttgggagcatttctaaggagtctgaattttattctatagacagggagaagtcattatagcgccttgaggcaagaaataacatgatcagctctacgttttgaaaagataactgtgctccacattatgtgtcattagggaaatgcaaattaaaacagcagtgacgtactattacatgactgttacaatggctgaaatccaaaacactgacaacaccaaagctggggaagatggggagcaacaggaactctcattcactgctggtgggaatacaaaatggtactttggaagattgtttggcaacttcttacatattcttactgtatgatccagcaattatgctcctcggaatttgcccaagtgagtagaaaacatgttcacacaaaaacctgcatacagatgtgtacggaagcttttttcataattgccaaaacttggaagcaaccaaaatgtccttcagtagatgaatgtataaataatctctgtactatacccagacaacggactgttattcagcaccaaaaagaaatgagctgtatcaacccatgaaaagacatggaagaaccttaagtgtgtgctactaagtgaaagaagccaatctgaaaaggccgtatactataaaatcccgaaatacgttctggaaaaggtaaaactatggagacggtaaaaagtgtagtgtttgccaagatctgaggggagagaggaatgaataggcaaagcacagaggatttgtagcacagtgtatgtattctgtgtggtactgtaatggtgaatacatgtcattatgcattagttcaaatccatcaagagtgaaccctaatgtaaattacaaacttcaatttatgtgtgaaaatgatgtgtcactgtggggttcatcagttgtaataaatgtaccactctggtgcaggttgtgataggagaaggctgtgggagtgaggggcatataggaacattgtaatttctgctcagttctgctgctcaaaaaaagaaatctattcaaaaaggagccttttcatgtttagactaacttagttcatttccctcctttagttccttcattggtgaggtttcattgcaatgcattctcaagtcgaacataaaattattttagagctttgtgtgacttttccccttgcttaaacatcattgcggaataatgtaaaaatatgataccctaatctagttttcataaacttttttcaaagttgaaaaaaaaactagcatcatggacagatgggttgaaagagtgaacggcaagaatcgaggatcaaaactaggccatgaaaattgctcagttgagagctaatgaagccctaaattaagtcctaatcattgtagatggagtgggtgacagatttaaacaatattaagaggctgggcacagtggctcatgcctgtaaccccagcactttgggaggccaaggcgggcagatcacaaggtcaggagttcaagaccagcctggccaatatggtgaaatcccatctgtactaaaaatacaagaagtagccaggcatggtagtgcatgcctgtaatcccagctgctcaggaggctgaggcaggagaatcgcttgaacctgggaggtggaggttgcagtgagcccagatcgtgccactgcactccaacctgggtgacaaagcgagactgcgtttcaaaaacaaacaaaaaacaatattaagaagtcatattgtctagaattggtcatttctaggtgtcatggggttgggggaaaatccaaaatgattgacagatcattttgagtgatggcatgaaaggcatctctttaccaagatggggactacaggaaagcaggaggtttgtgggaaaaattataagttttgagtacattggatttcagaggcctctggaatatcatgcttatggagtggagattactaacaaaaccaccatctttaaaaataactgcttctttaaacatgcttatattgtagtgagttcagtgatatatcctttggtagaaaaaattgtaaaaaaattatgtatggcacatttctctgacgcttgcactttcatagtgttcactttctgttcacctaggtttacttactgatatccttctcccactctgaggctttgcctatcctgaaatacatctaaacatttacccatgtcagaaacacttcccaactcatcctataaggccaatattaccctgataccaaatccagacagacataaagaaaactacagatcatctcttatgattatagacacagagatcctgaggaaatacttccagaccaaatccatcaacatatgtaaaggttacgtactatgtccaaatgggatttatcccagtaatgcaaggttgatttgacacacaaaaattaatgtaatatatgaataaaagaggaaagaaaatcacatgatgatttcaatagacactgaagaaagcatttgacaaaattcacaccccttcatgattaaaaagaaaccccactaaaataggaatagaagggaagctcctcaacctgataatggttatctataaaaaccccacggttaacgttatacctaatggtttccttctacagtcaggaataagacaaggatgtccagtctcaccacttttattcaatcttatactgaaggttctagagcagggcaattaggcaagaaagggaaataagaagggcatggtggctcacgcctgtaatcccagcacttgggaggccgaggtgggtggatcacctgaggtcaggagttcgacaccagcctggccaacttggtgaaaccccgtctctactaaaaatacaaaaatttgcctggcgtggtggcggatgcctgtaatcccagccacttgggaggctgaggcaggagaatcgcttaaacccagcaggtggaggttacagtgagccaagattgcaccattgcactccagcctggacaatggcgcgagactctctcaaaaaaaaagtgggggagggaataaaagggcatatagattagaaagggagaagtaaaactctatttgtaaatgacatgatcttgtatataaagcttttatatagaagatctttgggaagaactaaataactaaatgaactaaataaacagttcagcacagttgcagtgtacaagatcaatatattaaaatcagttgtgtttctatacgctagcaatgagcaatctgaaattaagacagtgattccatttataatagcatttaaaggaataaaatacttaggaataaatttaacaaaagagaacaaaacttgtactctaaaaattgtgaaacattgtggaggtaaattagatataaactgaaaaatagtacgtatttatggattagaagtcttagtattaagattgcaatactctccaaatctacagacttaatacaatccctgtcaaaatcccagctaacatttttgcaaaatgggcatacttaaaattcgtatggcaattcaaggagtccagaatagccaacaatctaaaaagagaagaacaaattggaggactcacacttcctaatttcagaacttactacaaagctgcagtaattaagatagggtggtactggcataggtagatcgctagcataaagagtctggaaataaaccttcacatttacaaaaaatggatttttaacaaggatccaagacaattcaattgggaaagaatgatttttctgacaaatgatactggaacaactgtttatccacatgcaaaagaataaagttagaccctacctctcaccatacacaaaactaaattgaaattggacaatacacctaaatataagagctaaaactatacaattcttagaaaaatatataagtcaatctttactacttgggataggccaagcttttgaagtatgacaaaagaaaaatagccaaattagactttaccaaaatgaaaaacttgtgtgtctcaatagatgccatcaagaaagttaaaagacaacccacgaactgagagaaaatatttgccatttatatatccgttagtgtttttatctagaatatgtaataaaaaaactcatacaactcaataaaaaatccaattaaaaatagacaaaatatgtgaataggcatttctccaaagaatgtatgcaaatggccaataatcacattaaaatgatgctcagtaccattagtttttaaagaaatggaaatcacaaccacaatgagatactacttcacacccactaggatagctttaatcaaaaagacagaaagaagtattggcaagggtgtggagaaattggcaccctcattcattgttgatgggactataaaatgatccataccatttagaaaaatttggtagtgccacaatttgctaaacataagagttaccacataacctagcaaagctacttcagagagaaaggaaaacatatgtttacacaaaaacttgcagttgaatgttcatcttagcattatatgtaacagcccaaaattggaaatgactcaaatgctcatcaactgatggatggataaacaacatgagatatattgctacaggggactattattcagcaataaaaaggaatgaagtactgatatatcctagaacatgatgaactttgaaaacattatgctaagtgaaagaagccagtcacaaaaaaatcatatatgatcctatttatgtgaaatgtccagaatagaccaatttggagatagaaagtagattagtggttgccctagggttgagtgggggactgggggaatttgggagtgttggttacagggtatggggttccttttagaggtaatgaaaattttctaaagcaaatgtggtgattgttgcacaactctgtgtacatcataaaaaccagtgaattttaggctttaaatgagtgacttttatggcatgtgaattatatttcaataaagctttttttcttctttttttgagatggagtcttgctctgtcacccaggttggagtgtagtggcgtgatgttggctcactgcaacctctgccttcttgactcaagcgattctcctgcctcagcctcccgagtagctgggattacaggcatgcattaccatgcccaaataatttttgtatttttttggtagagaccaggttttgccatgttggccaggctagtctctaactcctgacctcaggtgattcgactacttcagcttcccaaagtgctgggattacagatgtgagccacttcacctggccctcaataaagctatttttgaaaaggtttaaccacctcaccagaaagacgtgtatcatttgtcctagtttaagttcaaggcccccatttacaaatttttcactgattaatagtcttttcatgtcactacatagagatctccttccttgttttcagtgatgtgcacctctgggtctttgcactggctcctgccactttttcgaacactgttctcagaatccagcttgtttcctcactcttcgatttctctgtgaggcctccctgatgaaatacacacaacaggaagcctgctaacacataccaccctgtgctcctggtcccctttcctgtttcactgtttaccacggcacgtgttgccagggacaatgtatatttacttattcattgtctctacttcccactaaagtaagtgccacataggcaggacttttcgttccctgtttgtatccctaacaccctgtccttaataccagtgcttggcatgtggtaagccacaggctcttgtggctatacaacatttgctctgttctcaagtggggtgattctgtcgatgtctggagaaactttgggttgctatgccttgaggattaactaggtgctactgacatccagtagctggaggccagggaggcttctgaacactgtagaatacacaagaccaccctcaacacaaagaatgattcagccccaaatgtcaacagtgctgaggctgagaaaacctgtgttagaccagcactatccaatagaaatacaaccaaccggtcgggcccggggtctcacatctgtaatcccagaactttgggatgccgaggagggtggattgcttgagcccaggagtttgagtccagccttggtaacacaacaagacattcaacaagaaattaaaagattagctgggcatggttacacatgcctgtggtcccagctacccaggatgctgaggtggaagaaccaattcagcccaagaggtcaaggctgtggtaagccatgattgcaccactgcattccagcctgggcactgaggccacacttcctataggctgctcccagccagaaccgagcatgccagggtactagtgccacttgttcctgcaggacaagggaatcctctaacagtcaacagtccaccagagactcccaactgatccggccaaacgttcctagagctgtgctgtgtctcggactcctcctgccctaccttccttcctttcccctctcccctctcacacggcagtctgaaggctctccctgatcactcctggcccctctcttaacctgcacaggtgcatccccaataaatctctgctgatttcattctaacttggtgtctgcttctgggaggattcatactaacacaggtttcaaggtcagacagcattcaaatcccacttccatcacagaacctgagccagttcctacccctttctcagcctcagtttcctcagcagtgaaaagaatattgaaacagaaactctttgaaagctcttcctgtcctgatctgttccagaatcgggctcagcagggttcatgcaaggacacaagtgtagctgcctctgaggagcccctcacatgcccattttagccagtttgtttctccctgggctcctacagcacatgtgcccatcacacagggttgcaaacaccagttttcttctctgattccccaaagggtgctggacacctgtagaggggctctgttttggtcacttgtccatgatgctcagagaatgtttacagtgcacagtgaatgccgagcactggaaatgctcagtgaagcaagccaacaccagccccaccagatgtcagcaaggaggagttctgtggctatagtctctttggttccatggaaatgacaccaacaacccacataattgagggccctgtgcaggtgccgggttcccagcaaaagtctttgcatgtattttctgttatatgaatcctcctggcatgctcattgagaggttccattactacatgcccatcttcataaactaaacatgaataaactgaggctcagggaactggagttgatggtcccagcctgcacagctaggaagaatcaaggggtgagttttgggttttattttgcatatttcagcagctttactgaggtataatttacacaccataaaatttactcacaataaatgtacagttagatcagcaaatctatagatttgggcaaccatcagcacaagccagttttagaacatttctattaccctgaaaacatttctcttgcctgtttgcaggcaatcttccattcccacccccagccctaggcaaccaccaatctgctttctgactctacagatgtgcctttttctgcacattccctcttagtgaaatcatatactgtgtggcctttatggttggcttctttcacatagtgtaatgcttctgaggttcatccacgttgtaatgtccattgtggcttcatccctgtctattgacaaataaagttctgtttcatgggtggatcacaaacgtctacatatccattcttcagctggtgcacatttgggttgtttccagtcttgagccattatgaataatgttgttatgaaaatgtgtgtataagtttttgtgtgagaatatgttttcatttctcttgggtagatccctaggattggatttgctgggtcacatgatgagagtaagttatacaagaaactgccaaacttgtctatgtaaattggttgcccaccagcagcatatgagggttccactgctccacacagtagggctgagattggaggcaagtccagcccgaccccagaaccccattacccagctctttggtgatcctttctaacattgggatacccagctaaggaatgaggatcatagctgtgcaggaatgagggctgtctgtgaaaacaagaagtgctcctgcaccagcccagacaaagacccctcacttatctcatttatttcttgtcctccaagtgatgctggagcccctgggtttccccacatgcaatccctcaaatttctgacccctgctatttatcttccattgagccttaggttccggtgagagtaacaaggatagacaagggttcacagcccagggctagggatgccctataccctggtcagtgaccttggaagggctgattcagctggaactcaatattgaagcacctaggatgtgcctgtttacacacagaaaaaagataatgcagaagcatggggtccctgattagctgatctgagctggggtggggcttggcaatcattggatccagtgcttttcctgaaacatgagcattgagtttcctgcccacacaaccctgggcttaattaagtccaagcaacaaacagggtcctcagtatgcttaaaggattgacattggatggaagacaattcaatgtttgagaaatccctgcagaccctctgggagtgtcttgaattctaaggagaccatcttgccctacttccttatttgacagaaatggaaaactgtggctcactgaggtggagtgaaataccccaggtcatccagcaaggtgagggtggagcaaaggcttggtcccatggcatatattcatccatctccttgcccatccgttgtcttccagcagaatgtaagctctgagaagataaggattttcctctccttttctacaactgctgtcttccttgattctagcacagtggctggcacaggttgggtgctcagtaaatatctggtgaatgggccaggcacagtggctcacgcctgtaatcccagcactttgggaggccaaggcaggtggatcacctgaggtcagaagttcgagaccagcctggccaacatggtaaaatcccatgtctactaaaaatacaaaaagtagccaggcatggtggtgggcacctgcaatcccagctacttggaaagcagaggcaggagaatcgcttgaacctgccaggcagagattgcagtgaaccgagattgtaccactgcactccagcctgggagacagagcaagagtctgtctcaaagaaagaaagagagagagagagagaaagaaaaaaaagaaagaaagaagaaaatgaagaagaaagaaatgattctaagttattgtttttaactgctgcagagtattctgtggtaggaacatacaatagttcatgtagttattctcccaatgatgaacctttagatcattgccaatatctcactgctaccagcaatgctgctaagataatcttgactatactttcttgcacacacatgcaaatgttttggttttaacagatatgtcagatgccctccaaattgactgtactaatatgcactccctttggtgggacatgagggtacccgtttgtccaactctggctaacatttgttatcaaagttaaaaatacttgccaatctaatcagtaaaaatagcatctcaatgaccttttatttgtatttccttgataaatggtgagatcgagcattttttctttcttagcaattttaatttccttgaatagtattttcatatgaattgcctatttgctattcatttgatttttttcttattgcccatttattatgaacactcatttgtttggactttattatctttgtgtctttttttttttttttttttttttgagatagagcctcaccctgtcgctcacgctgaagtacaatggcatgatcttggctcactgcaacctccgactcccaagttcaagtgattctcctgcctcagcctccaaagtagctgggattacaggtgcccaccacgaagcccggctaatttttatacttttagtagagacagagtttcaccatgttggccaggctggtcttgaactcctgacatcaagtgatccaccctcctcagcctcccaaagtgctgggattacaggcatgagccaccatgcctggcctatctttgtgttttttattgatgatgctctgtttctctttttgtccccattcttgttttctgttgggttgattgaaatttctttgttccatcttatttccactactggtttgaaatttatacatttcattgctatttttctaatggttactcttaattttttatatccatatataatgttgcctaacaaaatctgaaggtaaactgtacatatagactcttcccaaacaagataagaaatgttcacttcctccccctgttttcctttttcccaagtctcctgttgatataatccagaattctaattccaaattgttattttaagcatccatggcaatcaatactttagtcttaaataatagcattggctgattacttagggaagtgttacttttttcgcactccttcttcctctggtttcatgtcatttcttgcaggagggcttcttaagtagttgttttcaacagaatctgttggtggtaaactttcttaaatcttgaatgttcaaaaatgcctttgggccgggtgcggtggctcacgcctataattccagcactttggtaggccaaggtagtcagatcacttgagcccagaagttcaaaaccagcctgggcaacatggaaaaaccccgtctctacgcaaaaacaaaatacattagccaggcgtggtggtaggttcttgtagtcccagctacttggggggctgagatggaaggatcgcttgagccaggaaggtcaaggctgcagtgagccttgatcatgccactgcactccagcctgggcaacagagcaataccctgtctcaaaaaagaaaaaaatggctttgtttcactgtgcccttaagtgattctgtagctgggttatagaattcagcatcaattagttattttccaaagctcattgaagacatggcttcattggcctgtatctagtgttgctaatgaaattaatgaggaaaatctgatccttatttctttgaatttaaactatttttttttttttttttttttttgctttggtagcttttaacatttttttctctattttcatagctttcttcacttttggggaatttttagctattaattaaatactactttctcccattctctctctgcctttggaattcctactagacgaaagcttgaatgcggtcacccagactttctggctcttaaccttttcacctttttctctttgttctttaacctgcaagactccctcaactgaatgctccattttgctaatggacccttcagtgtgtctctgctgttactcagcctatcttttgaggtttttctttcaataacttgggctttaatttttgagatctctaattggttctttttcataattgcttggttttattttcccctgttttgctgaaggtattaaatgtacttgctttaattgacctttggttgtagagaagatttttcatttgctctatttgttatttctctttcatagcagtgggcttcctcagacatctggcacttcttcaatgcacactagatttctggtttccaattctccacctgagtctcaggattctgcagcattcccaggtgggtgcagactcaggttacctgggccttggcttctcccatggcttcttaagaacttccttgtttatttctgtgatcccaagcactcccctttatgacttcaagcccaattgtatagtcagtaatttaatttctctatctgttctatcatttataagggcacagcatggaggggagggcctttcagatatttttcttgccccatcttaaatccctaaattacacttaaaaaaataccaccaaagcttttgtcttttatttaggaagaatagagtactcagacatgagtttggagtaggcgggtgtatgtgtgtatgtgtgcctatgcagtttaaacctgttctgtaatgtattgcaataaatgtttcagtgtcggtacagtgaacaattcaacttcataataggccaatctggaatctcccagaaaaatttactttgggtgttagtgctttttttttttttaatcattaatatctataggaagacctagtaggagtggctgacaaagtttaataaatctcatgataaaatgcttgtttttgatgtgaatgttgttcctcagtccatcctaaaatgaaattcacagggttgggttcgatgtcttcttccacacctctcattacaatctgccataggagtgcagaccgcccccatctgaggcctggatttaatgctcaaacaagacagatgccagcaggaaatatttgccctgccttcgctgtaaatcttgagtccttgtccatgatatcctaaaaggccaccagatggaaatgtgatgccgtgaaaagagatgcactaccctttgcaaagggggattgaccctgctgctctctcaaaagaaattgtccttattcaatgtaaaacaaggttttagaaatttttctttgttgaatgtagaataaagagggcattacatgaatgcctatgcatttcagctttggagaggaatccttacatccattctgacagcatggagataaaaagtctgtctttctgtattcatgttttgttgtcatttgctttcttttctcccttcttggtctgtgtgtaccacatcctctctatgtcttctctttctttcttttttttttttttgagacggagtctcactctgtcaccaggctggagtgctatggcatggtctcggctcactgctacctccgcctcccgggttcaagcaattctcctgcctcagcctcctgagtagctgggactacaggcatgcaccactacacctggctaatttctgtatttttagtggagacggggtttcaccatgttggccaggatggtcttgatctcttgacctcatgatcggcctgcctcagcctcccaaagtgctgggattacagatgtgagccaccgcacccggcctatctcttctcttttttgtcctctcctttgttacctggaaccaacttttcatccctctggcctttgtctcttcctattttctggccatatgtggatcagaaaaataattataaaaatgatttgttgttttacttactacaaatgtatgatttctgttttcattgcaaaagccaatgggtaagaatttttaccattccttcactgtaaaaaataaaactgagggccggtggcggtggcttatgcctgtaatcccagcactttgggtgaataaggtgggcggatcacgagttcaggagactgagaccatcctagctaacacagtgaagccctgtctctactaaaaatacaaaaaaaaaataaaattatcggggcgtggtggcaggtgcctgtagtcccagctactcgagaggctgaggcaggagaacggcgtgaacctaggaggcggagcttgcattgagcagaaattgtgccactgcactccagcctgggtgaaagagtgagactccgtcttaaaaataaaaaataaaataaaaataaaaaataaataaaactgaggccaggtgtgatggctcctgcctgcaatcccagctacttcggaagccaaagcgggaggattgcttaagcccaggaggggttgaggttgcagtgagctatgattgcaccaccgcactccagcctgggtgacagagcaagatccttactcgaaaaacaaacaacaaaacaccaaacaaaaagctcctgcattctgccaaaactaactgaataattttaaaagtattttattgagttataataatccaaccaaaaattgtacctattataactgtatgtctcactgattcacaaataaaaaaccacagtcatttaaccagtactcagattaagaacaagaacattacctgtacgcctgaaacccccatctgtccccatccagtctctaccttcctcttacccaaggacaatcatcacccagacttctaatagcacagaataatttcacttatttttgtgctttataaaaatggcatgaaacgtcctagtttgggttcccctaggagctgccctgagacaagtatttggcgacagttcttttatctggaggcacagggaacactgagtggggcatgaagaagtgagccaggaaaaaggcaggcagcagccataaagaaaaatgtgttaccaggccaggcgcggcggctcatgcctgtgatctcagcactttggaaggccgaggtgggcagatcacttggggtcaggagtttgagaccatcctggccaacatggtgaaaccctgtctctaccaaaaatcaaaaaattagctaggtgtggtggcaggtgcctgtaatcccagttacttgagcagctgaggcaggagaattgcttgagcccaggcggtggagggtgcattgagtcaagatcacaccactgcactaacagcctgggtgacatagagaaagaccctgtctcaaaaataaataaataaataatttttttctttcttttttttggagagacagttctcactatgttgcccaggctggttttgaactcctggactcaagcaatcctcccatctcggttctcaaagtgctgggattacaggtgtgagccaccatgcccagacattttcatcattcattttttttttttttttttgagacggagttttgctcttgttgctgagactgaagtgcaatgtcaccatcccggctcactgcaacatccgcctcccaggttcaagtgactctcctgcctcagcctcctgagtagctgggattacaggcatgagccgccacacccagctaattttgtatttttagagtacaaggggtttctccatgttggtcaggctggtctcacactcccgacctcaggtgatctgcccatctcagcctaacaaagtgctgggattacaggcatgagccactgcgcccagcccattttcatcattcctaatagccatggagcattccatttaatcaactgtatatgcatttttttttccgggggcaaggggctcatattcacacacatgggaggccagttggtgagaaggtggcaggcggcatagccaccttatacagcatgccatactggtccactgtcagaccggtgatggccacagctccatcaccccccatgctgactctggctcctgcctggctctgcccggccaccacaacccctcgggaccattcagaggcatcactggagggtgtgtggttagtggagcagctggtcatggggaggtctcgtttctttggtggaaggcattcctgactcctctcatgaacaggtttcatattgctttgtggtgttcctggagcctggaaggagttggcttgctccctggggcatcaggaggggcttctcggtagcttccctgtacccctcactgcttctggctggggcgcccacatctgagcttccagtggtgcttctgaacagctgtagtaagcgtcctcccggctggctcgggagccagcccgtttcacagcgcttcctgggatccacccgctcatcctgcagccgccgcaactgcagccgccgtcatcccggccctggagcccccacacacccctgtgtatgcaatatttgttaaccattcccttttggtgcccatctaggtacaggtctcatttttcaagctaaagtatctgtaatacactggaagtaatagatgtcacctccatattgtatgccaaacctaataagcagagcaaaacttttcatccaagtgatttggttaacattttaggatgtttctaatctctcagtaatacaaatatgctacaatagatctgtgtgcttatcctttgggcacttgtgtgtacctgtgcatacctggagaataaagtcctgtgagagaaactgccatccaaagagggtgtttcagtctgtactgccaccaacaatgtgctcgtgcctctgagcttgcgtttgggtcaggagaatttgaaagtcatcaggaaccaaaccaggatataaggttcagctgcagctggaaagtggcaaacgttccaaagctaagacattggctattcctgggctgttcacaaactgtgaggccaattctagatgagatccagaaaaagggtgagcagctcacttattttttaagcaaaacaccttttcttctcatttctgctaagaacaaatagcttccagcaagataaataggggatgcaatatttttacaaattatttctttttttattaaaaaaaattttaggttaaatgcgacttaagatatgtttaacctctatgatactgacttgctcatgagaagaaagagagagggccaggcattcttgcccactactacccactatcaacacttaggcctgacatcagtctctaaataaatattctgggccaggtgcggtggctcacgtctgtaatcccagcactttgggaggccaaggcaggcggatcatgaggtcaggagatcaagaccatcctagctaacatggtgaaaccccgtctctactaaaaatacaaaaaattagccaggtgtggtggcgggcgcctgtagttctagctactcaggagactgaggcaggataattgtttgaacccaggaggtggaggttgcagtgagccgagaccatgccactgcactcctgcctgggcaagagagcgagatcccatcttaaaaaaaaaaaaagaaagaaaagaaaagaaaagaaaagaaaaaaaatcaacagaggcttctaggatgactgagcagtgactcagtctctccttgatcagattctgtaaccatccagcagaaaagtttacctgatctgtgggagaacaggaagcagctcagtgggggccttccttgctaaattcttcatcaagctggtctgttatctgccctgagtcctgcaagaacatctcaagaaaaatcccaaaaacatgcaagacaaatgaaggtcctcccttagcgtgttcttgaagcactgaggtgcctgaaaactatatatactttctggggaaacagttttttaggaaatgtagcacagacactaactattcttccaggagagccccttcctgacatgaaagatcttagcatgagagagaagcatctgattcatcatggggacatatccaaccagcagcaggggccccagtgccggtgtccacctcagcagaggagacacaggggacatgaaaagtgtttccattgaaaaaaacttcacctagggtgactatagttagcaggaatgtattgtatatttcaaagtagctagaaggctaagtgtggtatcccatgcctataatatcagcattctgggaggcgcaggcaggcagaacacttgaggtcaggagttcgagaccagcctggctaacatggtgaaaccccgtctctactaaaaatacaaaaaacaaaaaataaaaaattagccgggcgtggtggcctgcgcttgtagtccaagctactcaggaggctgaggcaggagaattgcttgaacctgggaggcagaggttgcagtgagccgagatcaagccactgccctccagcctgggcgacagagcaagactctgtctcaaaacaaaaacaaaaacaaaaaaacaaagtaactggaagaggggacttcaaatgtgtccaacacatagtaataccaaatattcaaggtgatggacaccctaaacaccctgattgatcaccacacattctgtgcatgtaataaatactcaaatgtactccataaatatgtaaactattttatatcaataaggaaatactttgcctagcgtttccatccaaatgggaataaatccagggctctacgtacatatttcatggctttttattgagacttgggaagggtgggccatggtagcaggtgcattcactgtccaagtttgcccagactctctgctgcatgggtgatggcatttgtgactgtgttggtcactgtctcagtgacttccttcatctttttgtcccctgactcttgggctttctttatggcttcggcaatggctgttggaaagaaagaagaagaatgtcctagtgatccacccactgaacttgtatccccttgagtggcctgtgggatgtggccatcttaatggattagtccatggagtggcccaatgggaccaaggggagcaggactcctggcagaatgaatttgaatttggttttaatttccccaacaacttgtatttcttcaactctgagactgagcatctactcatgggtacattgcctgcttatcctttttttctggaaaatgcctgcttatgtcttttggccatttttatgttgggttgttatattgcattatcatttctattacaaatatttttcatagtttgtgatttttcttttggcttggtttatagtattttttttttttttttggctatagaaaattttgaagttttggattgtcaaatttatttaatatttcctttatggctgctgggttttttttccatagttctaaagattctcccctctccaagattaggccaaagtctcttatgttattactatgtctaaatgtttatgatgtcttccccctcaagactcatacgttgaaatcctcagctctaatgtgatggtattcagaggtggggcctttgggaggttgaaattagcacccacataaaagagaccacagagagctagctccttccacaatgtgaggacacaactaggcccatccacgaaccaggaagacgccctcaccagatgccaaatctgctggagccttgatcttggacttcccatcctccaggagtgtgagaaataaatttctgttgtttctaagtcacccagtttatggtttgtttttgtttttgtttttgagacagagtctcgctctgtcacccaggctggagtgcagtggcacaatctcagctcactgcaacctccgcctcccaggttcaagggattctcctgcctcagactcctgagtagctgggattacaggcatgtgccaccacacccagatgatttttgtatttttggtagagacagggtttcaccatattggtcaggctggtctcgaactcctggcctcagctggcccacctgcctcagcctcccaaagggctgggattacaggcatgagccactgtgcctggcctatggtattttataatagcctgagctaagatagttatctcctataagttaataaattcatgtatgtaaatttcagtccttcatctacccagaatctattttgttgaagaggaatgagatatacacatgcttgtacatagttctactcatagctcacacacatcaatttgacatttaacatataattttacatgttaaatgttttgtcccagtgtgctgtcacatagtcttttgtgactttgtcttcttatcattccatggagagaaccatctagacagtgccctaacatagtacagtctgtggcctctgatgaacatagataactgtcccagccgagaggctctgaaaggctgcaacattaggtgcagagtttgacccggttagtcaaagaacaggttggcccagcacctagcttcccttcctccctccctccttccatgcccgacctcagccagctgtacctttctctccagtctccttggcatgtcccaccacctccttcaccacttcctccatggcatgaactgaacagaggagacaagtccagggtgagggctcagagcaggcccgctgcccccgagtccaggatgagggctcagagcaggcccactgcccccacagcccagggtgagggctcagagcaggcccactgccctcctgagtccagggtgagggctcagagcaagcccaatgccctcccagtccagggagagggctcagagcaggctcatgtcccctgagtccagggtgagggctcagtgctgacccatttatcctcacaatggacctatacgtccctggacatccaaggtggggctccgggatgccacccccagccaggacagactggctcattagaaggaacttcccccacagctgccttcatttggagatgccgggacactggctgatgggagacaagctcagtgagccccatgagggcatgggcccctgaagccccttggccctgcccagcctggaatgtcaatgatcagactgtcttgccagctgagacctggagaccaggctaggcctctgtgccagattacatccctctcaggatgtgctggcgcctgcctcaggttaatttccaaagcctcatccagtaaaaccatgtctctcaaagcaattcctccaacaagagggaattctctgcctacttcagagttttttaaagtgtgggtggtagtgtgctagaactgaaagattttggagtcagaagaaatggttcttattctaactctcccttccacctcttggttccctcatctttagaatgggaatctgttgggatgatcagagccaacaccaggtcgtgggggcaacaaagtcccgcggagtcaaaagaatgagaaaaagttcaagagagaaagtgggaccagggggccattgccagtgtggaggctgcaaaggcactgagctctgggagcccatgctatttattggtgatctaacaaagaaacaggtggtgaggatgtggaggttgaaaggaaacagtgtagcaagtgaatgagaaatatatggctacttgagataatgggaatgctggaatcaagaagccagcaagtctagcagacatgcaagccctgcctcagcttctctaccaacactcagcttttctcccaacaggaatcatagaaaactcagaggctagtgaaaggttaaagcaggtggttatcaccagctgcagagtcaaaaacaaaatacacatctgctgccatgtagaaagaggacacaaactcaggcaaggctgtttttcacatgatgacccatgagtggggcctggctgggcctccccacacacagctgctgacctctgcatacaaaacatgcttcggcccagaagcacgccagcattcacccacctgtgggtatcagtcaggctcctggtggaagccagaggacatattcgaatgggtacttgaggaaaaggggctgttcacagaagtgtggacagagttaagggaaccaatgagagatgagaaatgccctggaccagcaagagtgggagctgttatctccctgggtctagagggacaggaaaggtgtccacagaccccgaagagagctgtggctgtaggggaggatcatcaggagctgcagccatcactagaaagatgtggccactggcaaaccagcaaggaagaatctgagtgaataaccacctctcctctctctcccacctcctatgacatcccccactgtctgaattccactagggccagacagtgaggaaccttggtgatgcagtccaagagggagtgggcagagaggagccagtgggtatggaggggaaacagagaaacagagaattccagctcactctgcgggatttctgggtctgatagaaacatagcagcagcttaattattattattttgagatggagtttcactctttttacccaggctgaagtgcagtagcgtgatcttggctcactgcaacctctgcctcctgggttgaagagatcctcctgcctcagcttcccgagtagctgggattacagggacatgccaccacacattgctaatttttttattttgggtagagatcaggtttcaacatgttggccagactggtctcgaactcctgacctcaggtaatccgcccgcctgggcctcctaaagggctgggattacaggcatgagccactgtgtccagcctgcagcagctcaattttacagtgtcccttttctccttctggaaactatatagagcaacaacaagactgaggaggaggaggaggagaaggaggaagaaaaagcccatcatcaacatacacatcaaactcaacttcagagaaattaggaagctgggaagccacgtaaacccaaaagcaggtgacaccagcagaaccaacacaggaagccagggaagtgcagaagaacagggcatggggggccacccagggggaatcttcactgttgccagcaacacacactcccagcaagagaggaccctcagagtgagaacgcagagctggagaagtgaagaaaaaaggaacaggtggtgtgcggggaagtccaggggtgcgggatctgacagcgtcccttcccaagagaggcaggaacacttgggaaggcagggctgagtccctggaggctgtatccgggaaaggaagctggcagtagaaccttcctgaagccgagttggttctgagaggcagaggggcagtggtacaggtgaggccgacgcttctgtgcaggaagggcaggctcctgaggaagggagccccgaatgctctccactagattcccagggagtcccactccctccacagggaccttgcgctgacatctgggaaatgccattcatactggaacctccgacacactgccatgaatgtgagggtttcgtgactgatggggtaggtttctcttttccaattcaatagtataatttccatttattcctcccccagcctccctgaacattcacatcttagatagccacagtacggtgatcagaaccaggaaatccacattctcatatttaactatattaaaattatttcacaaaataaccaattttgttaatttaaatacatttaaatgacgtttaaatgtatttaaattatttaactatttaaaaatgaacatattagctaaactaaagaccttattggagttttgccactttttccactaatgtcctttttctgttcccaaattccacccaggatcacgctgcatttagttatttctcagtctctcgccgttttgtaggactgcaataacagttcctcaatctttccttatctttcataaccctgacatcttgaaccagtactgatcactatttgtcaaatgttcctcgatttgggtgtgtctgatgtatttccatgattggactgaagttacacacttttggcaattacagcacaaaaatgatgtggaatccttcccagtgcattccttcagagttatggcattgatagttcttcttactgatgatgttgaacttgttcatttggttcaggtttctgctggatttctccattgtaaagttactatctttccccctcatagggggaaagatcttaggagaaatacttggagactatgaaagttttgtattttctcaaactttaaaattttttttcaggccaggcgcagtggctcacgcatgtaatcctagcactttgggaagccgaggcagatggctcacctgaggtcaggagttcaaaaccaccctgatcaacatggagaaaccccatacctactaaaaatacaaaattagccaggcatggtggtgcatgcctgtaatcccagctactcaggaggctgaggaaagagaatcgcttgaacccgggaggagaggctgcagtgagctgagatcgtgccattgcactccagcctggataacaagagcaaaagtccatcacacacacacacacacacacacacacacacccacaaaaaaaaaaaaaaaaaaaaaaaggccaggcacaatggctcacacctgtaatcccagcactttgggaggccaaggtgggtggatcacctgaggtcaggagttggagaccagcctgaccaacatggagaaaccccatctatactaaaataaaatacaaaattagctgggcatggtggtgcatgcctgtaatcccagctactcgggaggctgaggcagtagaattgcttgaacacgggaggtggaggttgccgtgagccgagatcccgccattgcactccagcttggccaacaaaagcaaaactccatctcaaaaacaaacaaacaaacaaaaaacacctattttgacagccgggcatggtggctcacacctgtaatcccagcactttgggaggccaaggcaggcggatcacctgaagtcaggagttcaagaccagcctggcgaacatggtgaaaccccgtctctactaaacatagaaaaattagtttggcatggtggcatgtgcctgtaagttccagctacttgggaggctgaggcaggagaatcgcttgaacccagaaggcagaggttgcagtgagccgagacggtgccattgcactccagcctgggcagcagagtgagggatctcaaaaaattataataaaaaaataataattctattttgaatagtggtaaaatacacataaaatttactaccttaaccacttctaagtggcagttggaacaggggtcaaggagagcccttgggttgggtaatgtatattcacattgccatgcaaccaatctccggaactttctcatctgacaaaaccaaaactctatatccactaagcaacttcccattttctcccttccccatgtccctggcaacccccgttctaccttctgtttctattagtttgcttactcagtctggacgcttcacataagtgaaggaacaccgtatttgtctttttctaactggcttatttcacttagcataatgtcctcaatgttcatccatgttgtagcatgtgttagaatttccttcctttttaaggctgaagaatattttattgtatgtatataccacattttatcaattcatctgcctatggacaattcggctgcatccatcttttgacgagtgtgaataccactgctataaatatcagtgtacacatatttctatgagaccttgctttcaattattttggctatatacccagaagtgatattgccggatcatttggtaattctatttttaattttttgagaaactgcctgtcctgtgctgagcaggtctatataaacctatctgcaaaggccaaggaacctgagataccaaagaaagaggctgacaaatccagtttctcagaaagaaacatttaataggcgtttatgaacagaaggcaagtcagggatggcaccaagataagatggtggatccctgtgccatcacccccacccccccgacccagggcttctatagcatagggaaagggtaatgcgggcttcagcagggatgtgtatggccagacacggtggctcacgcctgcaatcccagctctttgggaggccaaggtgggcggatcacctgaggtcaggagttccagaccagcctggccaacatggtaacacctcgtctctactaaaaatacaaaaattagccaggcgtggtggcaggcgcctgtaatcccagttactcgggaagctgaggcaggagaatcgcttgaacccaggaggtgaagtttgcagtgagctgagattgtgccactgaagtccaacctgggagacagagtgagactcagtctcaaaaaataaaaaataaaaaataattttgttaaaaagataaaatagaaatcgtagatgaattcttggaactgggattaatcagaacatggcagattagcatccaacatggaattgctttattctcattcaaggtttccctcattcttcactctccccatgctggtcaccttgctgtttgttcctcaaacacatatgacatgcgtttctgtcttggcagtcatcctgctacctgtaatgtcagcactgctttctgttgtcccttcagtcaggtcactgttcaaatagctctctagacaggctcttccttatcattctacttaaaatagcccccaatcactctgtgtccctttagcctgcttcctcttcctgctatttcatactacctgaaaaaatacttgtttgaacttcctagaacataagctcataaaagcaagaactgtgctccacctctcctctcctctaccccagcactcagaagagcaacagagtcagcatccagtgagtgttcatgaatcaagtcactgcttggcagaattcagcactgggaccacagcctcgcctatcttcaactctttctccttctgcttttcctcctcccactctagtagccactcttctgggggcttgtcccttaaatgattagtccttactgacctattttctgtccactttatctgtttttgagagagggtctcactctgttgcctaggctggagtgcagtggcatgaatatgggtcactgcagcctccacctcctgggctcaagtgaacttcctgcctcagcctgccatgccatgtaactggggccacaggcatgtgccaccatgtccagctaatttcttgatttttttttggtagaaatgggtctcactttattgcccagtctggtcttgaagtcctacactcgagcagtcctctcaacttggcctcccaaagtgctgggattacaggcatgagatactgtacctggtcttattttttcttttcttaagatacagggtctcaccatctggcccaggctggactcaaactgctgagctcaagtaattcccccatctcagcctccaaagtagctaggactaaaggcatgaaaacaccatgcttggcttgtcccatttcattctacacactttcttggtatttaaacagctgctgttgctcttcattctgtagctctacatcagattcatgctctagtcctgtatatcaaaatgatgactagaggctgccggctccgctctttcaaaggcacaatgagcgtagcccgtctacaaaactctcccttttccaatccagctttccctcctgcatcacctatctctctacatctggaaccatcggcagctgccttcataaggcacctcggtctggcattcggaaaacaaccctgtcttgccagagcctcctggtcttgggtagcaaaagctgtatgcaatctaaatcaagctttcaatcatgagaaatcacattccttcttttccctttgtaatatactcatgtgtttttttttttccctttctcaatcagcaaattgtaccaccatcttattctgagatgctcctttttaaaagctgtagatcacattaatggaagtgtttactgctgggaatattttccatgtgcaatgatctgtaaccctctttttcttttcttttttttgagaccgagtctcgctctgttgcccaggctggagtgcagtggcacaatctctgctcactgcaagctttgcctcctgagttcatgccattctcctgcctcagcctcccaagtagctgggactacaggtgcccgccaccatgcccagctaatttttttttttttagatggagtctcgtttggtcgcccaggctggagtgcagtggtgcaatctcagctcattgcaagctccgcctcctgggttcacgccattctcctgcctcagcctcccgagtagctgggactacaggtgcccgccaccacacctggctaatttttttttttgtatttttagcagagacggggtttcaccatgttagccaggatgggcttgatctcctgaccttgtgatccccctgcctcagcctcccaaagtgctgggattacaggtgtgagccaccaggcccggccatggccagctaattttttgtattttttagaagagatggggtttcatgatgttagccaggatggtctcaatctcctgacctggtgatcagtccgcctaggcctcccaaagtgctaggattacaggtgtgagccactgcgcccagccaatctgtaaccctcttatctcaactaactgacattattacttcacatccagttcaatttataaattaagagaggtgccatgggccgggcacggtggctcacgcttgtaatcccaacactttgggaggccgaggcaggtggatcacgaggtcaggagttcgagaccatcctggctaacatggtgaaaccacgtctctactaaaaatacaaaaaattagccaggtgtggtggcaggcacctgtagtcccagctacctgagaggctgaggcaggagaatggtgtgaatccgggaggcagagcttgcagtgagcagatatcacgccactgaactccagctggggtgacagagcaaaacatcgtccaaaaaaaataaaaataaaaatgaaaaagaggtgccatgtgtacaaaaatcaatgcatatttatgaactttatttcaaatatattttcacacattttatctaaatacataatacagaagcctgtgtgacttgggcaatgtggccaggagggcctgagactaacaaatccaccttggcaaaaggacataaaatacgtcttatggtcagaaaaatcaacattttgtgtatttacttagtttacgaaaagtactgaaaatgctattattagctgaatttgtgatttccttttgaaattctgagttatccttatttttcccattttgtttttgcaccaaggagactgcagtcaaataaaacagatactacacacacttgtcggggcagccgtactgcagaagcacgttgatgcactcctggctggaggcctgccgggcgtaggtcagcgctgtgttcccgtgggcatctcgggccatgacgtccaccccgtaccagatcaggagctgcgccaggaccacattccccttgcggcaggccagatggagcgccgtgcagccgtctccctccccacaggtctcgttcacctcctcacgggagccatgtgccagcagcaggatggctgtctgcaggtcctcatcagcggtggcccgcagcagctgctggcccagggacagctcagtgcagggtagtggggccagaaagagcttctcctcatatttggaacggatccaccgttccttctcttccctcgtggacttttctgagggttttgtctgcccctggctgctcccttcccagatgctgttggctaggtcattgccaatagatgacataaccttcctgagctcaactggccagtcatccagctccagagatcgcacacgggaaaggcgggtgccaagactgcggtggattcctgagcattcaatacacatgaggactcccaagttcaaactggcccacttaggattctgggtctcacagtccacacagtgggcgttcccacgcatgttttggatcgactgcagggccatggccttgctctggctggtcagctgggacttgcttttactgctctcgcatgactgcaggctggccaggatctggctctggatggcttggacccaggcatcccgctcctcatacgtcgtggcttcaaagtgccacgtttggccagtggcagacacaatcataaagttgttggtgcttttcttctttaggtgtttctttttattggcatgaggagaggggggcgggttgagcttggggctggtggtgctggagatactggggctgaagcatatggagtcacccagcccggtgtccatgtccttggataggccattgcttttagaggtggagatgggtgtgcaggccgatgtggctagggatggccactttcctgggactttgatggtagatgtctgaaggtcaatctcttttttatgaatattcttcatataatcacctaagcttgaataataggtgagcacgccattggaacacagggtgacgtatttctttttccatgtcttcagccatttcccacttcgctttaagagcatgccctgtttaatggggatggctctgccgctcccgatggtgtcagcatgattctccggggctttcctctctttgtctgggtcactccctttctcagatgtaaacaggttggaccagcgcatggaccgcttgcaaacgggggtgggtgtgttggcagtgggaggaacactgaactgagggtcctcctggctggtgctgggagtcgatggaatggaggaggaatagttatttaaactcccacctccatttcttttcttcataatgtgcacggtggaaacctgtgtggaacagaaggaggaatggcttcaaaaattgggtagtggcttgcagggtcctatagacagctcacaattaccttttaaaaagatacattttctgggccaggcatggtggctcacacctgtaatcacagcactttgggaggccaacgtgggtggatcacgaggtcaggagttcaagaccatcctggccaacatggtgaaaccctgtctttacaaaaaaaaaaaaagaaaaaaaaattagctgggcatggtggcacatgcctgtaattccagttactcaagaggctgaggcaggagaattgcttgaacagggacctgggaggcagagcctgcagtgagccaagatcgcgcgattgcactccagcctgggctacagaaagagagtccataaaaaaaaaaaaaaaaaaaaaaaagatacattttctgttgtttggatagtatatttactcatactagctcactaactaaacagagctgcagatcagttcttactccagcacattctttttacaacacttaagatgactaaatgcaacatgaaatggggaagatttaaaaaaagatggctttgacttcagcatgaaacagatacaagtgtacgatgaaaatacaacctcaataaaagtgccacttaccgcaaatgagtgtaactgttcatcaggtatgctcaaagatctatctgcatctctataaaataagaaagcgcattacttcaaaaactgttaatatcttagtataatatttgtttagtaaaatactgcctcctgtgtgctttggtgtttactttaccaaagcagtttttacgaattcttctcttggatcctgacttgcagagggtttcctgacttcttctttctcagcacatcatggcctgtaccgtgaagtcttttatatgataaccagtcagaaatgcccgtgagtattgactctccctaacaggccatggcaataaaccaaacatattttcactcttctaaccacacattgaaacacaagaatgttctacaaagcagttgtagtaaactttaataaatgtaaatgtgattcagatttcctagcttcctttctctttagttctctgtagtatactctcatgatgtatttatgtactttctgttgtttgaatgacaaactcatctgcctttttaagacgccagtctttgatgaactttaaactttgtaaaactaatgcattgtgcctgtgtataaaccagtggttctccaaatgtgctctgtggacctctcgggatcccgaagaccccttccagaaggcctaagaggtcataactgttctttttttttttttttttttttttttttgagaccaagttttactcttgttgcccaggctggagtgcaatggtgtgatctcggctcatggcaaccttcgcctcccaggttcaagtgattctcctaccccagcctcccaagtagcagggattacaggcacctgccaccactcctggctaagttttgtatttttagtagagatgtggtttcaccatgttggccaggctggtcttgaactcctaacctcaggtgatccgcttgcctcggcctcccaaagtgctgggattacaggcctgagccactgtgcctggccaacactgttctgaatcatactaattaaacctgagaaagctgatgaaaaattttaaaaatttgtgaaagtaatacaaagtcattgcctgctttttcattgacacttgccatgattatataaaagcaaaagtgggtacaatggctggtttctcagcataaatcaaggcagtggtaccaattacattagtagtcattctattcttcactgtcccctacaggtaaaaaacatagcctgaatttcttaagaatgtctttgatgaagcagtaaaaattaatgttgttaaatcttgacatgtctctaatattctgaataagtggaaagttaaccagaagcgctttttttttttttgtttttaaagaatccgtgatttaactgtgaactgaaaaatcacttttttcacagaacatcatttttatttaaaagtacaactgggccagcgcagtggctcacgcctgtaaaatcccagcactttgagaggccaaagcaggcagatggcttgagctccttcaggagttcgagaccagcctaggcaacataacgaaaccctgtcactgtcaaacatataagaaaattagcctggcgtggtgccacacatctgtggtcccagctacaaaggagcctgaggtgagaggattgcttgagctgagatcatgccaatgcactccagccaagtgacagagtgaaactcggtctaaaaaaccagttcaactatcattctcaaaaataaatgaagtgagaggttgtcacttcaagggaaatacgtatttgttcccaatgataaaatttaagctttcctgtggactttgaaaaacttgttccttctactgtaggcttggcagcttttcaatacttaaaggcgtgttaaagaaagattggtggttaaactaaaagtgatttttgacacaataaaacataaaccaatatattccaagtaactaatgcatgatattataaatgcaagtatggagcaaaagatccatttactgtgcaagaaagatcaatgagtactgatggaataaatttattaatatgtaaaatgccaccgtaactaatttaagaaaccaccacttgtgaagttttgatttagtgttaacaaatacccacaactgtctgaaaactttaaaaatacaccttctaccaactacatatttgcatgaggttaggtcatcttattgcttctttttttctttttttgagacagagtcgctctctgtcacccaggctggggtgcaatggcgagatctcggctcactgcaacctccacctcccaggctcaagcgattctcctgcctcagcctcccaagtaactgggactacaggcatgcaccaccacgcccagccattttttgtactttcagtagaggcgggttttaccatgttggtcgggctggtctcaaactcctgacctcaagtgatccacccacctcggcctcccaaaatgctgggattacaggtgtgaaccactgcgccccaccagcttattgctttttttgtttgtttgtttgtttaggcagagtcttgctctgtcacccaggctgcagtgcaatggcaccatctcagctctctgcaacctccgcctcccaagttcaagcggttctcctgcctcagcctccagaataggtgggactacaggtgcgtgccatcatgcccagccaagtttttgtatttttagtagagacggggcttcgctgtgttagccaggatggtctcgatctcctgaccttgtgatccgcccgcctcagcctcccaaagtgctgggattacaggcgtgagccaccgtgcccaacctcttattgctgctttaaagcaaattgcaaagaaagctctagagaatccatttgtctcctattaagctcaacatgagagactttaaataatataaatacatgacgcactttttactcaactttttgttgtagaaaagttatttttcaatgaaaaaattctgttaacaatactgttctcaaggaatattttctgttgttataacctgggtcatgggttactactgatatctagttggtagaggccatgaatactgctaaactctctgcaatgcacaagacagtcctcacaacaaagcattatctagcccataatatcaacagtggtaaggctgtgaaatcgaaactaaaaatagattttgaaaaaatttcaattgtataattctaccacactaaatatcaatataatcaatataaacacatactctttgagattctcaatcatttaagaattatgagagtcttaaggaacaaagaaaatacaaataatttgcttcaatattttagtaggcacaatacagcttatgatgtctagagctgtgacctaacactgagcttgatatcttgcaaagtacttagctagaataacaagacaggtttctaaaaagctcacctttgtgtgatatgatgaggtatctccaaggtcacactgtggaaggaaaaaaattcataacaatagatgttaacatttgttaggcctgaagacattttttaaaaggggggcagaggaaactctcctagtggccctgaaattcaaatcttctagttcagaacagtaccataagggcactttgttttcatttctttgttttttacaaaaatatgagaaccaaaatgcaaggaaatatgccgttagaagacgcgtttctgttggtgattacaatatataaataataacagatttccttgttatatgcttttctacccacgaaacctttcgtcccatgcgatttattttatgtatttatttattttttgacccagagtctgtctctcttgctcagactggattgcagtggtgccatcttgactcctcacaacctccaccacccaggttcaagcgattctcatgcctcagcctcccaagaagctgggactacaagtttgtgccactatgcccagataatgtttttttggggggtggggtggatggagtttcgctcttgttgcccaggctggagtgcaatggtgtgatctcggctcaccacaacctctgcctcccaggttcaagagattctcctgcctcagcctcccaagtggctgggattacaggcatgtgccaccacacccagctaattttgtagagtgaggctcaaaacaactgagggaaggcaaatctcaattctactaataggtctacacaatattagcactttttaaaaagcctgtaacattagcaggtaagatggatatgtctatagtgcttcaagtagttttcatctctgaaataattttaaaatcacagaatttaaagttacatgctggaaaggaccaatgaccttatgtgacatttaattcaacactcgttttacagatcagggaaacagaccttaaaactgacttgcccaaggtcccaccaaattggagcagtttctcgtcctaaactcaaattaagcagtggctgtcaaactttgctgcacattaaaatcgcctgagaagctttaatatctgcctcatcttccacatgagacattttaatttaattagtattgggtatggctttgggcatcaaggttcttggtaaacatttcccaggtgatttcaatcagcagcaaagtttggaatgattgagttggggtgaaaatcagaatcttctgggatgcttttcttcacagaaagatgcctcacatccatcccgattttcctaaaaggcttctcagtgcctagagatagagggaaagtggagatgggaagatacatgtgtttgcagacttgtattttgaaaaaaaccttgcataagtgatctcagcgagttccacctatcccactgacaacagtgcactactgattcatgataaaacatttttcaaaatatcttcttgaagccaatttgccctattaatttgttcaataactttatttcaccaatagtgaatacaccaaatgatcatttctcaaacttgctggtggcaaattaaaacttactatactctcaaaagtagacttctaaaaagtagaataatgaggaaaaaagcacgaaatttgtttcagcaaaattaatcttcaaagctgcttttgaattatatgctaacatatcaaaatctttggaactcagaagaagccagggactctagtcaaagtaatttttgtgtatgtgtgctcagagatttaagagacttagctgactacagacatttagtgattactcaataggtcccaaagctcaggacttgagacagagtttgagtccagtttttgttcgaaacacaatttcctctcaactattgttaaaagggagggaggaaagtgacattattatgagtgtaaactttccacttttaattgaagtaaaagttattgacaattgaattagttaaaaaggctagtgcatttgaaacaaaattgtttataagctagttatgtgtacagaatgaaaagttaaattaaagataaagacattaatattctaaattagcactttccaaactgtgttctaaaaatcaagactaataacccaagaagatgagaataatgtacactggacagcccctgtggagctggtggtggtgttggttgttgttccttttaaaataaacttcatctcagggtgctctcaaagcgcatctttgtggcccacgaggtgctcatgcacaatgggagaaattcaaatgcagatacactgtggtgccagaagaagaaaagctgttccttcttccaaggataatgtccaaagtagtgcacactgatttaggcctatgatgcattgaaaaactaagtttccacaaaaaacattcaataaagggaacctatccttctcactgtgttcaacattgtctaaaggcataaaggcatcaaaaagatacactgtttctgggattgcttctttgctaactgatttttccttccaccacgacgtctaagattaaaagagaaactgatacttaatattcagaatctggatatcaatatatggttgactccaatttcttaaactgattgctgaaaaggacaaccaaatgactgaaataattttagaataaaggaatctgtccctcggcagcatagttgtactcacgatattattgtcattgtaagataatgctggatggctgtgctgtcatcaaggaatattgtcgaacacaagctgtattgttgactgaaacgcacagtagatacctgaaggggaagggaagtgtaagtcaaacttatcaaagtgtattattttctcagttaaaatgtcaaatgacaaagcactaagatatgtcttacactccatgaaatgcctgagtgtggtatcatgtgcactctatagaaaacccattggaggctctcaacttccagagatgatgtttaagatatgggttataaaatgctgcccttaatatggtacctgtcatcaaacctaacaaggattttatgaattaccgttaaaaataatgggaaaagtcggcttcgcggggcacggtggctcacacctgtaatcctagcactttgggaggtggaggcgggcggatcacgaggtcaagagatcgagaccatcctggctaacatggtgaaaccccgtctctactaaaaatacaaaaaattagccgggcgtggtagcaggcccctgtagtcccagctacttgagaggctgaaacaggagaatggggtgaacccaggaggcggagcttgcagtgagccgagttcgcgccactgcactccaggccggcagacaaagtgagactccgcctcaaaaaaaaaaaaaaaaaaaaaaaagaaaagtttaaaataagatttcatttttttttctgcagcaataaaaagcagctgagaatttctattaattaattaatttatttatttatttttgagacggagtctcgctctgtcgcccagactggagtgcagtggcgcgatctcggctcactgcaagctccgcctcccgggttcacgccattctcctgactcagcctcctgagtagctgggactacaggcgcccaccaccgtgcccggctaactttttgtgtttttagtagagacggggtttcaccgtgttagccaggatggtctcgatctcctcacctcgcgatctgcctgcctcagcctcccaaagtactgggattacaggcgtgagccacggcgcccagcccttctattatttatttactacgataaaatgtaatgtattaaataatcctgctacaagagcattttattgcagtgaatacaagactaatgcatttactaaattactaatcctaaatgtattatttcaggtgatattgttacaaaagaagtgtttcagattcagaggctctgtgtgtcagggctgctaggccaccaacaagtgaggaagccataggtttctctagtcctattttcttatgtggaggataaaaagagtatcacttacatattctctcacaccctgaaaacaaatgacaacttaaaaaatctaactttcacttcatgtttaaataagactgccaagacatgactcaaatgagactctcggagaatactttgcattcacttcaaaacttgatcaattgcattctataaatcatctgacctgcacctagccattttcctgctctacccctgctctctgcctagaatactgcttttctctttccttgcttcagcaagctcgactccatctaccctcttggatctctttgtcggcagccacaccaaaaaatgtatttttatacactaattagttgaattcaccactgcttacaagatgctaattcctgcagagtattccccttgtgagaaagtatgcctctccataagagtaagggagggcccttactcttcctacctccagctgctgagcatagaattttgagtaaatccaaaacttcgacaagtgtttgacaattcagttatcatttggaaggtaagtcttactacatttaattacagcaaaaacactactaacagtttactctttataggtattatttaaggtagtcacaaaatagaaacaaacactctaacgtcaggcagcataaatgagagtatgaaattttacaatatttaacaagaaatggaaggggttacttagtagttttaaggtttaatgacaaaaactagaaaataatcgtacctagtaatttagtaagtcaaaaccaaagccttaccatcaaaggtgcagtacccattggatgcggatgcccacgcactgacttcttctgctgtacctgctgcctctcattttaacccattaaaaatactaaagttgttttccttgtagacatctttcacctccttggttaggtctattcccaagtattttattttagtttagtttagttttgcagctatcagaaaaggggttgagttcttggtttgattctaagcttggtcgcttctggggtataacagagctactgatttgtgtacattaattttgtctcctgaaactttgctgaattcatttatcagttctaggagctttttggaggagtctttagggtttcctaggtatatgatcatatcatcatcaaacagcaacagtttgacttcctctttactgatctgcatgccttttattgttttctcttgtgtgattgctctggctaggccttccagtagtatgttgaatacaagtggtgagagtgggcatccttgtcttgttccagttctcggggggaatgctttcaacttttccccctttcagtatcatgttggttgtgggtttgtcatagatggcttttattatattgagctgtgacccttgtatgctgattttgctgagggttttaatcataaaaggatgctgcattttgtcaaatgctttttctgcatctgtttagatgatcatgtgattttttgtttttaattctgtttatgtggtgtatcacatttattgacttgtgtatgttaatccatccctgcatccctggtatgaaacccatttgatcatggtggattatcttttttttttttttgagatggagtctcgctctgttgcccaggctggaatatgcagtgtggtgatcttggctcactgcaacctctgcctccgaggttcaagcgattctcctgcctcagccacctgagtagatgggattacaggtgagcgccaccacacccggctaacttttgtatttttagtagagatgggatttcaccatgttggccaggctggtctcgaactcctgacctcatgatccgtccgcctcagcctcccaaagtgctgggattacaggtgtgagccaccgtgcctggcccgattattttttgatatgccgttgggaactacaaaacgttgctgaatgaagtcatggacacaaacaaatggaaagacaccccatgctcatgaatgggtagaatgaatattgtgaaaatgaccatactgccaaaagcaatctacaaattcaatgcaactcccatcaaaataccaccatccttcttcacagaactagaaaaaacaatcctgaaatttatatggaccaaacaagaaccggcacagccaaaacaaaactaagcaaaaacaacaaatctggaggcatgacattacctgatttcaaactatactataaggccatagtcgccaaaatagcatggtactgatataaaaataggcacatacaccaatggaacagaatagagaacccagaaataaactcaaatacctatagccaactgattttcaacaaagccacctaaaacataaagtgaagaaggtaaaccctattcaacaaatggtgctgggataattggcaagccacatgcgggagaatgaaactggatcctcaactctcagcttacacaaaaatcaactcaagatggatcaaggacataaatctatgacctgaaaccataaaagttctagaagataacattggaaaaacccgtctagacgctggcttaggcaaagacttcatgaccaagaacacaaaagcaaatgcaacagaaacaaataggtgagacttaactaaagagcttctgcacaggaaaaggaacaatcagcagagtatacagacaaccacagagtgggaggaaatcttcacagtctatacatctgacaaagggctattatccagaatctatgaggaactcaaacaaattacaattacaaaaatatggaaccagctcaaatgcccgtcaatcaatgagtggataaagaaaccgtgatatacatacatatatatatatatatgaggaataccacctcagccataataaggaataaattcatggcattcccagcaacctggatggaagtaagactattattctaagtgaaataactcagcatggaaaaccaaatatcatgttctctttcatacgtgggagctgagctatgaggatgcaaagccataagaatgatacaatggactttggggacttgggggaaaggctgggaggagggtgagggataaaagactacaaattgggttcagcggatactgctcaggtgacgggtgcacctaaatctcacaaatcatcactaaagaacttagtcatgtcaccaaatgccacctgttcccccagaaacctatggaaataataaataaataaataaagtacagcatttttctcagcaaacataaaataaaacaaagactaaagttcatatttttcactctccttttgggcaggacaaattttagataggtttttaaagaattagtaacttttttcctttttccgagacagggtctccctttgttgcccaggctggagtgcagtggtgcaattatagttaactgcagcctcaaactcctgagctcaagcgatcctctgcctcagcctcctgagtaggtaatacgaaaggcgcatgccaccaggcctggctaatttgttatttaacctttttgtagatatgaggacttgcgatgttgaccaggctaaaaatgaacaaatcttaattaacttaaatatttctaacactttgggcattcaggaaaacagctccatctatgttgtgaagtaatgggaagtatatggcagtggataaactttgaatgaaaatattaaacaaggccttaggagaaaagtgtaatatgcttattatagatacattaatttaaaaaattctctggcttaatatcattaattatactcaaattagactttgatttaaacacaggtcctaaatttggattaaatataatagattgaccacaaatttatttcgtctccctccggaagcctcatcagtcataaaataaaggttacacccatgaccagcacagaaggttgacagagataatttttaataaatgctgagacataaaaagtagataaaggagtggtaaataacacagaaacacaactttggtgcctacagaaagtgactggaacagaagcgagccagtttgtcttgcagaactaaaggcaggttgtgaacttacaggcaaatggcactttggaaagtagggtaaaatgtgaaaaaaaaaaaaaagccagcaaggtcagttgcaaatctctaactagagccccaagtccacctgtccttccatctgacaagaaacttagatgtgtgttctctggatatatcaaacctgagaatttctggctcagagataccatggcttaaacctgagatataaagaaaactgtacaccaaaaatggaactccaactttcttcgctaactctgcttttcctttccaggcctgcttttactttccaggcagaaaactgggagatccttctcagaagaaactgaaatgtcttcaaaaaagatccccagataatacactgaggtctcccaaatgaaaagctagtcaggcttctaaggcctcacactgagtgctatcagttaacagaaatcctgcttccaaataaagcaggccaggaaccaccacacattggagggaagcctccaagaaaagagatcaaaacaatagaaaaaaggaattgataggaccagtcaaaatcaggagcaaaactttaaaaaaaaatcttaaaacactctcaaaaaatataaaattcaatagaaatagtagaggataaagtcacagaatatcccagaactagaataaaaagacaaactgaaaaaaatacaaggggaaaaattaaaaatcaatgcaggcgtactggtctaagcagcctagcatctgaataacaagactatcagtaaaaaagtaacagagaaaataaaaaaaaaaattctcaagaagagatagtctgcaggtttagtagcctcaataaaatgaaaagatccccaacaagctgttataaaatttcagaaccttagagagagagattctaaaaagcttccgcagataactaaaacctggttgtaaataacatatcacacactggcaatagattcaagaacaacactgtaataagagcacaactgcaaaatgtcttcagaaccatacaatttagattcaacctagaggtgtactctctatcaaagaggagggattttaacatctccacacaggaaaatgtgttcaagtacaactagagacgataacaggacagaaggaaacacagaatctaggactcaggcgatcccacacaagacagcagttacatgagataccaaaagactttaaagagttagcccagaaaagcagacattgagcatatctagggaaacccacgctatattgaactaggatgacaaaaggccaaagaaagttgccccccacacaaacataaaaaggaacagatgtgttttcgcagatggaaaatatctttgaaaggcatgtgataaatgctacaatacttgggggaaaacagctgttagaaaacaggcaaatgaatatagtcagaaaattagcttcatgctaaaaaataatggatgtgaaagcaaacagagcacccagaggctacttaacgatatttggatagataaactaacgtaggctaggaaaaaagaagatccaggagaattgcagaagtgctcagatttcagaactgtttcagagacaggatgaaggacatggaatgcagaggcacagtgaaaacaccatatgacttagcagtgaataatatttgcagagtcataatcatgtaaatattactgatttaattaaaaagtgtgctacaattggaagaaacacagggagaaacataagatcatggtgtagcggggaaggtatgcttttacctgctgtgacagaaagtcaatagacagtgctggcaattaacttagctattctatttttgttctttcattaaaaataagattaaatatttaaggcaattttttttttttttttgagacagagttttgctctgtcgtccaggctggagtgcaatggcgcgatcttggctcactgcaacctccgcctcctgggttcaagtgattctcctgcctcagcctcctgagtagctgagattacaggcatgcaccaccacgcccagctacttttgtatttttagtagatacagaatttcaccatgttggtcagggttgtctcaaattcctgacctcagatgatcagcctgcctcggcctcctaaagtgttgtgattacagacgttagccaccatgcccagccttaaggcagatcttttgaaccggactattgaaatttaacttaaatgtcagaaatctttaaaaggtggacacgctaaactaagcacttttctggataaatttaatactcaggaaaatagaagagatttagaaaatccacaaaaagaggtccatgctaccaccaccaggtccacattgtaatttaaagaaatcaagagagacatccttttatgtcaaactatcaatttcttaactatttgagtgtttacttacatggtttgtacagttgcttcttcttatttctacaactaagaataaaaaaaaaaaaactggtcacttctgatacaaataccataaaataaaagtagttgttaacatcttactgattactcctatgaaaaatgagacaaaattccattaaaaaaaaaattttcaataacatataatttaaattatctggcatgattaatttcataagtcaaatctaaaaacttagattttcatttagtttactttttgtttctattacacacaaatgaaagaatcctcatgtacaaaagaaaagggcaaaaaaattaggccagatgaaaaatttagctaataaaaagtttaactgttgcatatatgagccatgatccattagtattctctcattctgcatttacacatagcttactttaattatcagactctaagagctaacagttctaaaaactacttcctgaccagacacctatctctagatgcaacagaatccctgtaagcatcttgaaccacacttagtggttatctactaatatgtcactaaaaacaaaacaaaattaaaaaatggtctttacacaactggaaagtaacctatcttaaatttgttttcttttttgagatggagtctcactctgtcacctaggctcgagtgcagtggcgggatctcagcgcactgcaacctctgcctcccaggttcaagcaattcttcagccttagcctccggactagctgggaccacaggcacgtgccaccatgcctagctaattgttttttgtatttttagtagagacagagttacactgtgttagccaggatggtcttgatctcctaacctcgtgatccacccacctcaacctcccaaagagttgggattacaggtgtaagccacagagcctggcctaaattttgatgttaaaataagtatacaaacctaattggacatggtgtctgcagcacaaaaaatcattttttttccctaaaaagaggccagaataataaaagccccaagagggacttgggccatgctttgtttcctacactgcctctgcctttgatgctgggagggccttgtaggcaaaagttactaccactgaagagtgagggacatggaatagcttttcttttactgcttccatgctctctaggtgtgagaagcccatgcctctggaaggaactgggaaatacaattctgatatgttttggatatgttgcccctccaagtctcatgttaacatgtgacccttaatgttggagacagggcctagtgggaggcgtttgggtaatggcagtggattccttatgaatggcttggtcccatccccatggtaataagcacattctcattatggtaatttaaaagactgtggtactggccaggtgcggtggctgaagcctgtaatcccagcactttgggaggctgaagcgggtagatcacttgaggtcaggagtttcagaccagtctggctaacatggtgaaaccctgtctctaccaaaaatacagaaattagccaggtgttatggtgcccacctatagtcccaactactcgggaggctgaggcaggagaattgcttgaacctgggagatggaggttgtagtgagccaagatcgtgccattgcactccagcctgggcaacagagtgagactccatttcaaaaaaaaaaaaaaagagtgtggtaccttcccccttcccctctctcctccctctttcacggtgtggaaccacctgcttcccctttgccttttatcatgattgtaagtttgctgaggccctcaccagaagcagatgttaaagccatgtttgtacagcctgaaaatctttgagccaattaaacctctttttgttataaattacccagccttaggtatctctttatagtaatgtaaaaaatgaagacaaattctaaccagaaataactgactcaagatgggcaaagtctactcaaactataaaaacaaaggttacaaactcccgtgttttactgtgctgcattacttcgcacattataatagaaccctcacttgtgttcttgctgtttaagtcaactggaaaacttggctgtgtatggcttgttggcaaataaatgaggatttaatataacattaagggaaataagcaggagtaaggcatgtttaaatttacattatatcaaatgaaaaagttaataacctaaaacttttgagtagcgtaaacttggatgtggtaaatgaatgtggtcagaggactgtgtaagaggaggcccaaatcacagattcaatccctgatgataaacgactatgttttttaatttgtttaaatgaaaaccaagctgaagttctatcattcatctttaaaatgtactttttggagcaagggaaaagggattgtaaataaagatgaatccattaattataaataaagataaatccaagaattataaagagaaatccatgactcctccatcacatcacaaattaattgtgttgataaaaagatggcaaaatgtataaacaaaaaggttacacgttttcactaacatcataacaactaaaggaaagtatatcacatattaaaataagacaagggaacatgtgaaaagatgaaaattttaaaccaatatgagtttttctaaatactttctataacctgatcaaacaagagcttttattctttctcttggtggaaaaaacaatgtcgtctcaccatctgtttgagagttcctctggaatattgtgcttgcctctggattggcagaagggttaaactccaaagctatatgcatagaggaagaaaagaaaaaaagatgtaatcattgataaaaatttatcaactcgtttattcgactgctgcatttaggctatttcactatctctactttgattcttatccattgaaatgaatgtatagacataagagagagccaggcaagatggcacatgcttgtagtcccagctactcaggaggctgagatgggaaaatcacttgaacccaggtcaggaagttgaggccagcatgagtaacataatgacaccctcctttatttaaaaaaaaaaaaaaaaagaagaggtaaattttggctttgagttgtgtaaaatcaactttgcataaaataaatcaagatggcagtaagttttaaaagacaggtctattttataggcaaaatataagatgtattctagagtttttaaaatttttaaaaagtaaattcatcatatctgtcacttccatttcattctgaggacacagaaccttagttctcttgagtagctgtcttccatagtcatgtgatatctctaagttttcatttcttcgttagcaacacatagggagaacatacacaggccttatttgtattggaaagggccaagtgagacatacataaactgtgttgtaatcctaaagaatgacaataaagagccatttttgggctctcatccaacactacccatctactaactggtgtgtaacatccatcaggctttccgaacatcaccaagcagagtataagtttacacaagtacttacatgctttgtgtataaaggtacaatcaattaattcacataatacatttgtttattctaaagcaatccttaaatatcttgaaatgtgaagatagtacttccaagttacaaagtcacactcataatgagtcttaattatcctacctctttaaaaattaagagcgcaaccaaagtttaaatagaagagctataagacatttcctctacagtgatgaaatctctggcatttaaatgaaaacaataagcctactggatgtaatatgtttatgatgcaatgttttctattttgaaaatttcagtttttattcaagaaccatattattacccagaattacttttacttagattcatctctttgcaaaattttagaggcaaacgaactaattgttttctcttttctaccggctcccatcccctgcctctgccagcagtgtagagactaaaaaactccaactttctttcctttttttttttgtgagacggagtctcgctctgtcacccaggctggagtgcattggcgtgatctctgctcactgcaacctccacctcccaggtccaagcaattctcctgcctcagccttgtgagtagctggaactacagtcatgtgccactacgcccagctaatttttgtattttttttttagtagagacagcgtttcaccatgttggccaggctggtctggaactcctgacctcaggtgatccgcctgccacggcctcccaaagtgctgggattacaggcgtgagccaccaagcccagccaaaactgtaactttcttatctttgaacaagatgctattgtcaggaggggaagggacaaagggggagccatggcaacaaacactcttacagggaaggtctgacattttaacctgcaatctttatattacacattgaaagtctacattgacgtttcatgtcttttgaaagttttgaccatgaaccaatccccacctctcttttagaacaaggaggtaaataaagtctgttaagtcaccagaataaatctggagacacattttctgttaaagtaagaactttaacagaaaagagcttcataggtaaactcctttgagaaaccccaaacacacacacacaaccatttttctgcagccccggctgtgacatttcacacctttcacaattattttaagcactctccttttttctttttccttctgtgttcaaattacagttagaagaaactaagcagcttctatcaaggtgacttaaagcagcccattaagaataccatatagcctctcccatggcaaactccattctgattttaaataagaaatccccaaatatttgaataggaactgtcttgagatttggctactttaacaaaggaaacaattaggcacttacctggttccttcacttaggtaccatctggataggtacaaagaaaaaataagatgggtactgaaaagttgggatatttgagtttttattgagaaaaggaagagaatagctcaaagaagcctaaacaaagtcccacaggataataaacagagctacagacactgttgtctcaccatctgtttgagagttcctctggaatattgtgcttgcctctggattggcagaaaggttaaactccaaagctatatgtatagagggagaaaagaaaaaagatgtaatcatttataaaaatttatcaactcatttattcaactgctgcttattcgacaagagccataaataaatggtcccatgccagcctgggagaatgagatgagagagcaagaactgggcgattgggaggggaggcgaaaagaaactgactggactcggtggggaaatactaaggggtgggaattcaaggcagagccagcttttgttcctggccagctcccgggaaagctggctacaagcagaaaggagctcgaagtgggggatgcctcaaagggaaccttggggacagtagcagccagaggcaaaccgagggtagatggcacctatcacctcctcaccttcaggcatctcccggtcacgaacgtggtgcatgtggaggtcctcaccaacttcaacagtcacctcagcaggctgtacagcagcagccatgggcgctcctgccatcctgtccccagctcctgcctcatagatctcagattcagagggacacaccgacccctgctgctggtcaaactcgaggctgacgctagggtgcacacgacaggtcagtatgttccccatggggcgcctctactgtctgccaccacctgtgcctctgctcacagctttggccacgcactcccgctgtcctaggccgaggctatgctgcacttgcagagatggtcttcccgctcctcgcctgcccacctcacagcgcggccccgggcaccagccctggccctggccctggccccggccccggctagggctgcgggccaaggcccgcaccctgctgcctcccctgagttgacttgtctgggagggtgaagaccagccggcttatttaataggttgtgaacccaacaagtgctgagagacacaacaactgcctgaagagagaacagacggagctcctcctccttctgtagtcacctacagactgaagcccactggccccaggtgggagcccaggcatgtggcacacaatgccccaccccacacttcacaatgccctccccgacacctcacagtgccccaccctgcctgccacccctccccaacagctcagaatgcccctgccttggctgccccaccctgtggcttatgatgctgctgctctcctggcccctcgtgcagtgccattgggactaaggttttcattcatcaccagcttcctgagattttagtcctaagaaaagcaaagggtagttcattacttgaagccatcttcctctatgagttctatacaaagcctcagtagagtgggtccaattagcaaccaagttgaacaacttttatttgctgactaaatatagatacacctgaattgttgactgcttttgtaactaaacactcctctcctgtcttccaacgagtggtcatttttgtccgcaacttgaccacagcaatccctggggccctagctctactctcaataaagagttatggctgtgtgttttgaatgacaccttaggacccatcctgcctccacctccttctccataaaatagaaacctaacttgcccctccaagctctgaaatgctgaaacttaccaactcccttttctccccgctatttcttccttccgtggcagggactttcaggttttctttcttttactaacaaggcactaagcatgattttctcatacaaaatcgagagccataaagtggcttaccacagtcctatttcaataaagatgaatactcgacatctggcaagtagtgtgtgcctgacagtgtccccactgtgctatgctcatttaaccctcagaaacaatctcatgttacagattttgcagaagttgttgagacggagaaggtaagcaacctccccaaggtcacatgactgctaagggtggggccatagtttgatcccagctagtctgaattccccagttgcttaagcatgattatcagaaagtatagcagtctgttttcacactgatataaagaaatacctcaggttgggtaatttttaaaggaaagaggtttaactgactcagtttcacatggctggggaggcctcaggaaacttagaatcatggcagagggggaagtccttcaggaaacttacaatcatggcagaagggcaggtccgacttccatggtggccgcacagagagtgggaacatgtgaaggagcaactgtcaaacatgtataaaaccatcagatctcagctgggcacggtggctcacacttgtaaccctagtactttgggaggccaaggcaggtggatcaactgaggtcaggagtttgagaccagcctagctaatgtagtgaaatcctgtctctactaaaaatacaaaaattagctgggtgtggttgtgcatgcctgtaatcccagctactcaggaggctgaggcaggagaatcactggaactcaagaggcagagactgcagtgagccaagatcgtgccatggcactcctgcctggacaacagagcaagactccatcccaaaaaacaaaacaaaacaaaaccctataagatctcatgaggacttactgaatatcacaagaacagcatgaggataactgcccccgtgatccaatcacctccccctaggcccctccctcgacacatcaggattatggggattataattcatgatgagatttgggtgggggcatggcaaaaccatatcagaaagtaaaggtagaagtcaagcttggatgggaaatgacattgtagatgatgatgatgatgattattattattattattattattattttgagatgaagttttgctcttgttgcccagtgaaattgtttctctaatttcattttcagattgtgtcttgtagatgtatagaaatacaattgataaatgattctggctattaaccttttatgcttcaaccttgctgaacactattttttttttttttgagacggagtttctctcttgttgcccaggcaggagtgcaatggcatgatcttggctcactgcaacctccgcctcctgggctcaagcgattctcctgcctcagcctcccaagtagttgggattgcaggcatgcgccaccatgcccagctaattttgtatttttagtagagacggggtttctgcacgttggtcaggcccgcctcagcctcccaaagtgctaggactacaggcatgagccaccgtgcccagccagattcgtatatttttaaaagaattttttttttattttttttgagacagagtctcactctgttgcccaggcagtggcacaatcgttgctcactgcaacctccacctcctgggtccaggtgattctcattcaagtgcctaagcctcccaagtagctgggattacaggagcccaaccccatgctcagctaatgtttgtattttagtagagatggggtttcaccatgttgctcaggttgatctcgaactcctgacctcaggtgatccacctgccttggcctcccaaagtgctgggattgcaggcgtgagccaccactcccgaacagaacaacatttttttgatgtggattttaaaatgcctccccttctttcaacattgattaagtcccttctacatgccaggcactgtatgtgtgaaatagtcccaactctcaatgagtgtaggcagatacacaaacaaagccttaaggaggtcagttttctgagaccatactgctggacagtatatgaacctgggatacaaacccacctctatttgacctcaaatttgatgctggggtggttttaattttattctgggaatttcagtcattgaaccatgaaaaggtgaaaagtctctgtcagatgtgtgtgtagtggtctgtataataaggactgaaggaagcaaccaaacaaattaagagactttctctaaaggcagagtaatgctaagggcagtggcagtgacaaaagcggaggaaaaagtctgtgatcatttgggagacagaataggaagtgcttggtcatgagatgtgaaagaagaggggaagtagaaggaaaacagagctgctcaggctctgctggggaagactgggtatgtagcagtgccttcctcctggccaagaatgtaggaagagaaataggtaaggaggaaaagacagttttttactctcagtgtcacattaaaatggaactctctggtcaaaagttgaatataaatctctgtaggctaagtccatttgtgacatcccaacatatgttttcaaaaataacatacatactaaatcaagccattaagcgtaactggggaaatttcctaaaatttacatgctaaaaaatcaccatttttcatttattagtttcatggagcaactttgaatctatggttacagcaattgaggcaccttgtataaaataaagctaatacatgaaaaaaaaaagccatttaaaattctgttgttctcagagaatggagaaagcaattgaagccatgggtgtggaggtgactgccctgagaagctgtgtatagtaaggagaactgggaagaaagaagacctggagaatagggtgatttgcacggcattaagtgaagcttgcaaaagtgagcactgagactcaagagacctgcatatgaatcaggaatggctgctcctgtgagttgttagaaaggagatgatgccttcttttcatatctataacagcagcacctagcacagtgcctgttcaataggtactcaacatgtattatcccaatgcagagtcaaattttgccaggagggcaggaaagccacaaattagctatggcaacttagtgattgggcttgtgtgtgtgtgtgtgagcgagctggatgtcaggcagtgggtaaagtagtgaactggaggtgagaaaacaatgacacaaactcagggcttctcttcccaagtatttggctgagaagagagatgtagtattaaagggagatatgtggtaaaggaagacttttattccaagattcaacaaaagcgtgagtatacttctatgttaaagggaaagagccaacagagaaaacacatttttgaggttagaagagaaggaagaactaatgcagaagggccccaaaaggcacaggtgcctgcaatctggatcagggacagattagctttggactcctacaaaagcaagaagggagaaaggaccatgtgactctagagatatttctggtaaaggaaaggtttaggaaaagatcttttgatgacctttattttaacagactttttttttctttttgagatggagtcttgctctgtcacccaggctggagtgcagtggcacgatctcggctcactgcaacctctgcctcctgggttcatgccattctcctgcctcagcctcctgattagctgggactacaggcacccgttaccatgtccagctaattttttgtatttttagtagagacggggtttcaacgtgttaggcaggatggtctccgtctcttgacttcgtgatctgcccgcctcggcctcccacagtctgggattacaggcgtgagccactgcacccggccagactttaaaaaaaaaaaaaaaaaaaaaaaaaactactgtgggaaaaaggatattatgtatagaaaagtctacacttcttgatacaactaactaaaaaaagcctgatacactaaacaaaacccaaataatgtcttccctaaaagtgggtaacttgaaaagcaatttgagcaaaaatcaaggagttcaattataaataagtatatcaacaaagtgaaagatgggtttaatttttcccacaaaaagttaaaagaaataacagcaggtttagaggaagaggaaaaaataataagaaaattatatgcagttgcaaaatgtgtgactatttacaaactctaacatataactacaaaatggaccagaagaatcattatcataggaagcaaagggtcatttcaaaaatcagaggagggatgattcatatttaatttaattctgtggaaaaaatttaagtaatgtttgaggacaaaaataggtgatgtgttgaaatgcgggaaaccacagtggaaggaaaaataattcaagaaagctcagtttcagtaaccagtatctagtaaaatcttcaggacctagaggctacaatctgcattaatagtgtctgaagacctagaaatgtcattaaataccattttggataattcttgtagacttgagatgatgtctatttaaagttacaaaatagtgcccatatttctgtattcattacagaaaacaattggatatggaaaagaaactaacatgctatgccacaatctctaaagaaagattagggaagtttcagcttaaagcaagaataatcacaataaagttttacaaccctttgcaagcatatatgaaaaacttacaaaaagtctgtaatgatcttttcttaagctaagagaacagaaaaaatgagaaaaattaaattataaaatgaaactttggtttagaggtaagaaacatttgatgacagtcaagagatcagggttgtacagtgtattatgtgaatgttgtgactcattggtttcatcttggatatcataacttgacattttgtaaaagtgatttttcatgggagtttcttcaggtgccctatgaagtcctgtccctttagaagcgaataatagtcttccacattcttgagatatcttaatgaataacatcttctacagtcttccattgtttagaccttggagagacacgcattagtgactgttaaggtacctgggttattaggtgcctgtagactatgcccagtgatatgtgcattaggtacatgctccctagctgtgctgacactgactgaagctgtgaggtttcacaatgacatgtcagccaaatacatatgctcagatttaccatttatcaagaggtcttcacactatcaattgtgcaattatcattctacacacaggcagcgataaagggagtaaaaaaacacagccatggatcgggagaccaaggtacctccagaggagtccagtgggtccagaagccctttggatgttggtcagaagctcctcttgggcagagatcacagcagcagccaacaggtctggagaagaccttacagttctcatggacaaagtttgtgaaggcatcttagacaagatcttgtctttgctggttttatgatcctctgcagatgggtctattctcattacctcagccacctttcacttcctatcagttcagttcaggtctctcatgatcccaggcagcagtagttgttatcacgtaagttcattcatatatgtttatctctggggatggggggacaacttcactgtggacttaattctactggagatgagtgaccccattttaagacaacaggatcacaaattattatcacatatcagcagggcagacaatagctacgacctggggctgaaagcaggtaactctatttattctgcaaaaattctgtcttgattatggtgccagttgctgtgagggatttcctttctagaacctgtttttcacaaggtttgagtctgaactgttaacattctactgatttctgggtgaagggactgactgcaccatcctagcctgtcagagcacttgccccaatacttccactttaagagttttccaccttgtccagaactacagtccactaatcccctcattttctctcttaagagaataaacaggccaggtgcggtggctcacgcctgtaatcccagcactttgggaggctgaggcgggtggatcatctgaggtcaggagttcgagaccaacttcgcctacgtagtaaaacctcgtctctactaaaaaaaaaatcacaaaaattagccgggcgtggtggcaggcacctgtaatcccagctactcgggaggctgaggcaggagaatcccttgaacctgggaggcagaggttgcagtgagccaagactgtgccacagaactccagcatgggcgacagagtgagactccctctcaaaaaaaaaaaaaaaaaaaaaaaaagagagaaaaagagagagacagagaataaacaacccatgtcaagtacacacccacatccctcttatcccaaataccaaacacacaaaaatccaatctgtctccttctacctaagcaattgcagatagtcacattcccataattaccttaagctccctgacttgctgctcgtcctttctctggcaaaatctcatccttggatgagcccgactttgtgtttgctcaatgacaccactcacctgaaccagaaaaaatatcaaaaagtggtcagagatatcatcataaattcaaattacttacataaaaaattggccctaaatgtttccagaaatcaataaaagttttgtttctccaaagacatcatttcttcagaaacccaacgtgtataacctattttttctatgttcttctaacattcattcaacttctctcatctgatatcttgccaaatcattcaaagagaaaatatatcccattagtcaagagccaaccatattcccatcacctgagaaaatcatatgcacaggatgcgcccacctcacctttctctgcctcatgtcagaaaaagtacccctccttttgtcacaaggcaaacctgagataaaagatttagatggcctgtaattccagcactaagggaggccaatgcatgcagattatttgagtctaaaaaagaagcctaagcaacttagggaaactgcatctctcaaacaaatacaaaccattagcctagcatggtggtgtggtggcacatgcctgtagtcccagctactcagggtggggagcactgaggtgggaggatcacctgagctggaaggttgtggctgcagtgagccgtgatcacgtcactgcactccagccagggtaacagatattttttaaaggatcttctctgttaaaaataatcaaataaacaggtggccatgaggctgaggtggctgcagtgcactcaattcctccttaaataacccaaaacttgactcagtgtaaataataaaaggaaacttaagtttaaccagtcagaaaccaccaactaacatctaactagagaccttccactgtaatgttccaaatgaggccactgctccacttcacccaatcaagtattttctttttcttccacattcaccatataaaattcttcccccaccctccctaagcctctctgtgggacctctgagctgcttgcagtctggggctgcctagtttatacatttctgaatgctcaaatatattttctaatgtttcaaagtggctctggtgtaggaggttgttggtggagtgacccgagagtatacaggaattgaggccatatgagatctctggaccctgtactccattttgctgtacactcaatactactctaaaataataatatatctttaaaaatctataactatcacgtagcccttttcaagtctccaactggttggagccagttcgattaaagctcagaaaaaactggttaataagctagttctgacccaactggcaagaagcggcaggaaagacccaggccaggggagcatattgcacatgcatgcaccaggaaactggaggaagcttggaggccctttagcctggtcctgagcccgctgaaactgcagttacaggcacagatgcctggggcaccaatctgaatctgccaacatccaaggccacatgaacacaaatgcacagtctcctctgcgatcggtagctaaggatgttaggccatgattggactaggatgggagatgaactgagaactctggattctgtaggttgttgttgtctcttcccacccccaagcaacaagtgatgaacacacacacacacacacacacacacacacacacacacacatcccgtagtgactaacaggatctccctccaggggatttgcaggaaggggagcagaaaacatcccaggggcctttcacagctacttccttgagccccctttcagacagtgctgtctagacctgtctcagcccaagcatcaccaccctgatacgcagaagctggcatccttacctgaaattcaacatcaagaaatgatctcttctactcaacactgatagaaatacctctaagcaacgtcctcattggcaggggtggagtgggggagtttcttaaaaagtgaggcctctgcctaccacctagagaacctggaaatttccatctgtgccacaaagtccaaatcactggccactgccccagtgtatggcagattagaacatctctccattggatctgggtttctattccattgagtgaaatgccttttctactacaggaacagaataagggatcaaaagggtcttacaactgaactccagtgtacagtctgcacagacactaggcttgtgcaaatatgacacagcgaggccccaggacccttaagccagctgaatgtactgagtttcaggaaacagtgagatacattcagcaaaacagtgggcttcatgctgaaagaagtcaatccaagtaaacacacatctcacacacacacacacacacacacacacacgcacgcacgcacgcagacaccctagtggccaataggtcctctcaccaaaaacctgcgatcaggagagcagaaagcctcccagggctccaccactgccctttctgtagccccttatcagacggccagcctcaggacagcactgtctgatcctggtccagcccaaaccgccatcaccctgtgatgtgggagcaggccacttcaccagaacctctgtggcagaaaaatttctttcttttaaaatgatgagggggaaccttcagacagtgtcctgattagggtgggtggagaggggggtttcccagaaagtcaggcagggcagggcagaagccctctgggttaactgtgtgcttttgatatgaaggcaggtaagactggacaggtgggggtgttagtgaggggatggtgtagggtgctgaagaactccacttgggctctgcgcaccagggaaaatgaccacaaaacatcccatcttcactgctcagagaaggctagatctgctgtgagctaggaagccatgtgggggcagctgatgagtcatcaaatgggagaaatctgagagccatgtgttccacaggcctctggtccttgttcaggcagcagggcactgtgagatgtggctccttggccctttccagccaccaccttgattgcctgctgcaaggaaagagactgaagcccaagaatggggtcttgctcaccataggatgatggctcagtgtgcagagctgagctatggcccaagaggcaaaaggtggggatgacccaggctgagctgggggatccaactgaacatgcacttgctaagaagctgtgggctatgatgccttgggaccccagtctgggtcgagaattgtagcaaaacaggctactggtaaaagttcttgggaagccaactcacttttgctttcatccgtgggcaaacaaacctctgatcaaccacaccacaatggtgtcactctgtaaggcacaggcagacaaggcatccagccttgcacactccagggcccacacatgtccagaatacaatggttcttgttgagactccactcttccaactcagacagaagctccccaatctcctcagccactcccaacaactggaggtctgaaaactttcatgcatgccgctatggtctaaaccactcgtggtggttttgattttcattttcctgataatcagtgatgctgagcacctttccatatgccttttcaccaactggatatcttctgtggctaaatgtctattgaaatccattgcccatttacaaatctgcttttttgtgggcttcttgatgtttttctttttttttttcctatttatttatacaagttccttagatattttggatatttttaaaaatgattttcaattccattgcccagttataaatcttttttttttttttttttttttttgagacagagttttgctgttgttgtccaggctagagtgcaatggtgcaatcttggttcacagcaacctccacctcccaaagtcaagcaattctcctgcctcagcctcctgagtagctgggattacaggcatgtgccaccatgcccggctaatttttgcatttttagtagaggcagggtttctccatgttggtcaggctggtcttgaactcccggtctcaggtgatctgtccaccttggcctcccaaagtgctgggattacaggcatgagccactgtgcccggccaattatccctttttgtggtttttttttggggggggtggggggaagaacagagtctcgctctgtcacccagtctggagtgcactggtgtgatctcggctcactgcagcctccgcctcccagattccagcaattctcctgactcagtttcccgggtagctaagattacgggcgcgcaacacatgcccagctaatttttgtatttttagtagagacggggtttcaccatgttggccaggctggtctcaaactcctgacctcaggtgatccacccacctcccaaagtgttgggattacaggcgggagccaccactcccggccccattttgtgttttaacatcagtcgacactcgtattttaaaataataacaatgaatggcggtaccttagaacaaggtaattatacatctttctcttgtcctagtgcagacattttgtctataaaatgttattcacagatgaattcatgaaaacattactgtgaattttaaatccatatacaagtgtatgcttgttcatgaatacttcaataaaataaaactaatagcaaaaaagaattccagagttgaagcagtttcaggaaaaaggagttggcagtatgaagtaaaatagaaaaaaatgggtttttttttaaatgggtatatttgtgtctacaacttttttttaattatagcattagacaatgtgtatatatatatacatatataaagcaatggaagtggcattgttttcatactagtctaggatattaaaatatatgtaatatgtgattggcaaaataatggccccccaaagatgtccacagattcctagaaccttacatgaaaacggtacatcatgcatgtgattcaggtaaagaccttgacatgaggagactaccctggtgctatggaatgaacgttgtgttccgtcaatgttcatgtgttaaaatcctaaccctcaaggtgatggtattaggaggttaagccttacgggagactctgccctcatgactgggattagcaccttattacaggcacaagggagcttgtttgttcctctcaccatgcgaagacacagcaagaaggaagcctctatgagaaagcaggccttcaccagacaccaagactgccggcaccttgatcttgcatttctcagcctccaggactgtgagaaacgaagttctgttatttataagctacctggtctaatgcatttccttgtagcagcctgtatggattaggacagtgggctcatgtggatgatgacggtgtgtccattcaggactaagtaagcacatgagtccttaacagtggaagagaagggggaaggaaagagccacagagacatgtggccacagaagaagggtccatgggatgcaaggttgctaatggtgagagtggagaagagcccaaagccaaaaaatgcaggcagactccagaatgtggaaaaggcgagaaaaaagatcccctagagcctctagagatgaaggtagcctttccaccacctagattttagcccagtgagatccacatcatactctgacatacaggagtgtaataaatttgttttatgccctgacatagtggtagtttgttgtagcagcaatggactagtaatatataaatatatatatacacacacacacacaaacactacccccccaccacacacacacacacacacacacacacacacacacacacacacacataactatatatatcctacccttcaaaattgaagcagataaactacacattagcattaacttagctgggtgtagtggatcatgcctgtagtcccagctactcaggaggctgagagggaggatcatgtgagcccaggagtttaagatcagcctgggcaaacacactgaggccacatttcaaaaacaaacaaacaaacaaaacacaacaaatctttgattaagctcatttcccaaatttgaagaggagacaattattagataaagaggagaaaagagaaaggtagagctgctgacttttgtggcggaagcagaggcacaggcccaaacatactcctttcctcctggctttcctgtcccttctcataagggacacatgaacctctcaaactgaaccatggatcacagacccatactcagaactcaatacagttttgttctatgattttttacatgtctgtgtccttgcttctgcctcccattcccaactcccttactctagttagaaaaaaatggctattaccaaatatgagtacatcctcatatactaatgccaactgatcatcacctggttttcttcttttacaaagtcataaatctttagactttaacacatcttccaagcaatagaatgttattttccagtccattaacacaaattctatatttaaaatgaagacttcacaagttgatttaaataacatattaaccaacatagactggccatggttcaaactgacattttaattaaatgtgatgataggttgagtaacctagcagtactctaaaatgacttttggttatggctttttccatattatgtttaggctgaggcatccctaaatgattcaactgtaattcctcttcttaaacatgagatttatctttacaaaataatttattttcttaaaattacaagttaattctatagttcatgcatacataatctcagcagatatcagctgtatgtgtacacacatacatataggtatttgtatatacacacattacataatttttttaaaaacttattagtagggtagaaccacgaagacaaagaggctttgtgtaatgtgatggaaacacatttgcaggacgaacaacaggctgctgtgagggctgcatttaccctttctactgtaagacttggaaaaacatggatagtggatatttaatccgcataacagaaatttcagggtgcagaaaacttcccacaatttttacagacaatgtcaacagacaggcattcaatgcagggaatacacagtgtgacagtatacaaaaataagcaggttgatggtttagatttatgagacaagagaaagaaatagatgatgccataattctccttttatggagttatgaaaattgttcattttatataaggtcaggtgctttcaaatgtcaatgagaaaaatatttaaaggaagaatcaaatctaagacgtggagagatctttataaaaatgaccttcaggccaggcacggtggctcacacctgtaatcccaacactttgggaggccaaggtgggtggatcacaaggtcgggggatcgagaccatcctggccaacatggtaaaaccccgtctctactaaaacacaaaaaattagccgggagtggtggtgtgtgcctgtagtcccagctacttgggaggctgaggcaggagaactgcttgaacccgggaggcagaggttgcagtgagctgagagcaccactgcactccagcctggcaacagagcaagactccatctcaaaaaaaaaagaaaagaaaaaaaattaccttcattctgagaaggtataatcatcaacacattcttgagcaaaactacgcacatacacacttccaaattcacaaaccatgcttgtgcacacactgatgtctctagattccttttttgaagagatggcaacttggtgtgtcacccaggctggagagcagtgttaggatcatagctcactgcagcctcaaactactggggtcacgtgatcctcctacatcaggctcctcagtagcctgaactataggaatgagccactatgcccagccaatgttttcatttttttgtagagatgaaatcttgctatattgcccaggctggtcttgaactcctggccccaaggaatcctcctgccttgccctccaaacgtgctgagattacaggtgtgaaccattgtgcccagcaactgtattctttattaagaagaaaatttgtttgctgacatgtaggcaatgaattgataagtaatagttcagaaattactaatttacaagtcaatataaatgaggtgagtaaacacaaaaataacagcataaataaacagttcatgacttcacgtttctttttctcctttaaaatgtagctctgacagagactactacttgtccattccatggaaaagtcagaggtggttaaaatgtcagaggtacacttactaatactttgatgccttttgtgtagcttcttctcagtacttcaccagctgggattgacacacctctacaggtgggttcaggagccagacagcagcacacagaatggggaatccaaagccatctctgacactaaaagcaatgaaaacaaaaataaccaaacatattatcaagaaatgaacaagagattgatatcaagtaaagcaagaagagaagaaagcatttaatctgccaggctttcattctgacaaaataatttacaacatgcatgtctctatctgacatgagtgaatagaaaaagaacccaaatacccagttgaattgcaagatgaaaatgaaaaagaactcttgcttattcgccagggtacaatctaatctgggctactaaaacactttcatgcactgattctatgtaacacatgctttattgccatttggaaatgggatttcttgctttgatttaaatatacttccttggatttctgctttaagtatactttcttaaacatattcacagctacattctcagtacaaattttcaggtgtaagtaactacttctgcttttgatagtataattggtgaaataagctatacttccatgtaaatgtgagagtacaaggtaagattccagagtcaagtaaaacataacagtcaagaaaataaaaaggtgagagtaactgggcagtggggaaatcttgtgtgtggaaagaatgaatctgtaaaactgttctttcctaagagagttcagcaggatttggatgatagagagctttgtgtacaagggttccagttccacatagtttaggtctaatttcaaaggcaacttctagtgcaacctgtgactcacgctgtcctaaagtgccaaatgtaaagggtctggagataacccacaagcagcactgtgaacccctgacagcaagcctttccagataaatacctgtcagtgtctatagctgatgacagagcagaatatctgaaaaataatacttcttcggccaatggactgccagtcactattatttagtgtaaaatactatattacatatgtgtaattttttaaattgcagtgtttcacatcgaagcaactaaatataaaaaccaaatgtttattcagcttaaaggcaacttagaaatactgatcccagatagaaagatgctttagtcccaagtcagctgttctaaaatgccacaactaaaccaacgaagggatcttgaagcatagtaagtgttcataccttttcagctatacctctgcttgtcttgaatataaaaacctaagctgcagttatgccacagcacagaatgtgttatattttacatcactgagccttagttttacaaatggtaaaaaaatagggaaggtaaactgaggttttcttaaggagctgttacatccaagagactcgtgaaaatctttgccaaatgtccccggtacatagctcctccccactgatgggctcaacggggagaagctatgcacatgtctcaatctgcatatgctcaatggcaatacaggattcctaggataaagtaagggatataaatgacacagcacactgaaaagactgtaatgttacttcagaatgttgcaaaataaagattacagatgaaagttttagttcactgaagcatgtagtcatgtatatttcatttgtgtgttttaaagtcttatactgcttacattctctttttttgtttgttttaaaataattatatttggctacaaagatcaataacaaggatgatgtcagtccaggttggacaggcagttctggggcagatgttcttgcagtatttttttttttttttttttttttttagtatttattgatcattcttgggtgtttcttggagaaggggatttggcagggtcataggacaatagtggagggaaggtcagcagataaacatgtgaacaagggtctctggttttcctaggcagaggaccctgcggccttccgcagtttttgtgtccctgggtacttgagattagggagcggtgatgactctcaaggagcaggctgccttcaagcatctgtttaacaaagcacatcttgcacgctcttaatccatttaaccctgagtggacacagcacatgtttcagagagcaccgggttgggggtaaggtcatagatcaacagcatcccaaggcagaagaatttttcttagtacagaaagaaatggagtctcctatgtctacttccctccacacagacacagcaacaatccgatttctctatcttttccccacatttcccccttttctattcaacaaaaccgccatcgtcatcatggcccattctcaatgagctgttgggtacacctcccagacggggtggcggccgggcagaggggctcctcacttcccagaaggggtggctgggcagaggcgccccccaccgcccagacggggcggcagccgggcggaggcgccccccacctccctcccggacggggtggctggcggggcaggggctgccccccacctccctcccggacggggcagctggccaggcgggggctgcccccccacctcccggacggggcggctgtcttgcggagacgctcctcacttcctggacggggcggctgccgggcggaggggctcctcacttctcagagggggcagctgctgggcggcggggctcctcacttctcagacagggcagctgccgggcggaggggctcctcacttctcaagacacggcggctgggcagagacgctcctcacctcccagacggggtcgcggccaggcagaggcgctcctcacatcccagacggggcggcggggcagaggtgctcccctcacctcagacgatgggtggccgggccaagacgctcctcacttcctagacgggatggcagccgggaaaaggcgctcctcacttcccagactgggcagcccgggcagaggggctcctcacatcccagacgatgggcggccaggcagagacgctcctcacttcccagacggggtggcagccgggcagaggctgcaatctcggcactttgggaggccaaggcaggcggctgggaggtggaggttgtagctagccgagatcacgccactgcactccagcctgggcaacattgagcactgagtgaacgagactccatctgcaatcccggcacctcgggaggccgaggctggcagatcactcgcggttaggagctggagaccagcccggccaacacggcgaaaccccgtctccaccaaaaaaatacaaaaaccagtcaggcgtggcggcgcgcacctgcaatcgcaggcactcggcaggctgaggcaggagaatcaggcagggagggtgcagtgagccgagatggcagcagtacagtccagcttcggctcggcatcagagggagaccatggaaagagagggagagggagaccgtggggagagggagagggagaccgtggggagagggagagtgagagggagagccagaatttcctttttacaggcagaataatattctatgtatataccacatttttctttttttgagacagggtcacctaggctggagtgcagtggcatgatcacggctcactgcagccttgacctccccaagctcaagtgatcttcccacctcagcctcgggagtagcatgtaccaccatgcttagctcattttttgtatttttagtagctatgttgtccaggctagtctccaactcctgggctcaagcaatctgcccatttgcctgcattggcctcttagaatctatctttttttttttttttttttctcactctgtcgcccaggctagagtgcagtggcacaatgaaggcacactgcagctttgacctcctgggctcaggtgattctcccatctcagccttcccagtaagtgggactacaggtgcccaccaccaagactggctaattttttgtatagacagggtttcaccatattgcccttacactcctggactcaatctgcccacactggcttcccaaagtgctgggattatagacatgagctaccacacccagcctgtatggctgttgtgaataatatgctgttatgaacatgggcacactaaacaccattcaacttaaaaaaataatcaaagccttaagaactgaaccaaaatggcttaggtgaaaataaaataccaaactctgctctaagaaaaggaaagagcattcactgaattataccttcagcaataagcacttaatggaacttgtttcatttaaaatgcaccacaatcctgtaaattgataatcataccgcaattttatagatgagcaaggtattaggcggacctttttcaaaaggtcatacagctagtgacaaatatttccaaatttttcataacatttctttttttgagacggagtcttgctctgtggcccaggctggagtgcagtggtgcaatctcggctcactgcaagccttgcctcccaggttcacgccattctcctgtctcagcctccctagtagctgggactacaggcacccaccaccatgcccggataatgtttttgtattttcagtagagacggggtttcactgtgttagccaggatggtctcaatctcctgacattgtgatcctcccgccttggcctcccaaagtgctgggattacagacgtgagccactgtgccaggcctaacatttctgttttaaatagcttaattaactacacatgttctatattcttgcctctgaaaggcagctttttttgttgggttggtttattatgcatcagacacttgatttgctgaggaattctgtttttcagtaattcatccaccacaaatatcacgtagcattttgactccacagacctaagagtcttaagtcttaaaaggattgtaaaatctaagtttttctgagatatctgagagtaagaggcttttttctattgaaaataggttgcatttcaaactttatctgtaagagctcacaacactttctccaacatgcatgcccatgtgatcacttaaacagaactctgagtgagacagtaaatacctcatatgcccttgaaaattttaccttggcatagaaaaaccttgttaagaacctaaaaataatttcactttgaaagtctttagggttagacaaatgttaaacttcaattggcagtacaagggcagcactcaagccagcaagagttttgttgggccaaattatgttgaaaaagatcaaatattttaaaaacaggagatttcacataaaaatctgggattccagcttcttctgaataaatgaggtacactaattatgcagagtggcaaatggctggagttgagtgggaggtgtttctagcccaacagataggcatggaagctccagctcagccccctccactccattttcttacacaagggaagccactatggtatagcatctaacttaaggcatattatatgtattcttaagacagaggaaaaggctgaatatttgatattgtcaaaagaaatgagagtctaactttctgtggcaaggaccttcttgcagtagtcacataacatagtctggaacacctccaacataaattatgaaaagaaagctcttggctcagaagagaaaaagcaaaaaagaatactcattaattctatgtcacaggacaaatagatttcaatttccattgcaattgtagaagaggtaaataatctgctgacccagaattccaacagggactcacacttcctgtcttaataactcgaaacactgaaatcactctaacaaaggcaaatcaatgtcttattaatttctggttaaaaaatagacccaagaagacagggcacagacataaattttgtgtggtgggaatacgaatataacttcaacgtccagattcatggatttggaaatgaccttgggcactctaagtatagcaccactgaagtttacatttagggaatggctaatccctgctgatctaaactatttccaatccccaatgtactctttaaatacagaaatttaaaaaaagagggggccgggcgcggtggttcacacctgtaatcccaatacttgggaggccaaggcagggtggatcgcttgagctcaggagtttgagactagcctgggcaccatggtgaaaccccgtctctacaaaaaacacaaaaaaattagccaggcatggtggcgtgtgcctgtagtcctagcatcttgggaggctgagatgggagcatcacttgaacccaggaagcagaggtggcagtgagccatgatcacaccactgtactctagtctgagaccctgtcaaaaaaaaaggaagggctcaacatagtaggtacagagctattttaatagaaagatcatgagggaaaaactagcagctgtcagatagagagtaatttattttattcatttatttatttttatttttatttttttgagacagagtttcgctcagctgcccaggctggagtgcagtggcgcgatcttgcctcatggcaaccaccatctcctgggttcaagcgattctcctctctcagcctcccaagtagctgggattacaggcacccgctatcatgcccagctagtttttgtattttagtagagatggggtttcatcatgttggccaggctggtcttgaactcctgacctcaggtgatccacctgcctcggcctcccaaagtgctaggattacaggtgtgagccaccacacccagcatttcatatttcatttctttcatttcaagatggaaactcactctatcaccccggctggagtatgccactgcacctgacatttcattattcatttcatttcattatttcatttcttcatttcattgcacccagcatttcattattcatttcattatttcatttcttcatttagtttcatttcatttcgagatggaaactcgctcaatcgcccaggctggagtgcaccaccacacccggcatttcattattcatttacttcatttcatttcgagacaagagacttgctctattgcccaagctggagtgcgccaccgcacctggcatttcattattcatttcatcatttcattttatttcatttagagatgaagactcactctaccgcgcaagctggagtgcaccaccacacccagcatttcattattcatttcattatttcatttcatcatgtcatgtcatgtcatgtcatgccatgtcatttcatttcgagacagagactcgctctatcacccaggctggagtgcgccactgcatctggcatttcattattcatttatttcatttcatttcacccagcatttcattattcatttcatcatttcatttcatttcgtttcatttccagatgaagacttgctctattgcccaggctggagtgcgccaccgcacccggcatttcattattccattttatcatttagtttcatttatttcatttcatatttcatctcatttcatttcatttcgatggagactcgctccattacccaggctggagtgcgccaccacacccagcatttcattattcatttcatttcacccggcatttcgtatttcatttcatcatttcatttctcacttcatttcatttcatttgtttcatttcatttcgagacagagactcgctctatcgcccagtctggagtgcgccaccacacccagcatttcattattcatttcatttcacccggcatttcgtatttcatttcatcatttcatttctcacttcatttcatttcatttgtttcatttcatttcgagacagagactcgctctatcgcccagtctggagtgcaccaccacacccggcatttcattattatttcattttttcatttcatctatttcatttcatttttcaatttcatgacgtagactcgctctaacacccaggctggagtgcacccagcatttcattattcatttcatatttcatttcccatttcatttcatgacagagactcactctatcacccaggctggagtgcgccacccacatttcattattaatttcattatttcatttcatcatgtcatgtcatttcattctgagatggagactcgttctattgcccaggctggagtgcagtggtgtgatctctgctccccgcaacctctacctcctgggtacaagcgattctcctctctcagcctcccgagtagctgggattacaggcacccgctataatgcccggctactttttgtattttagtagagacagggtttcaccatgttggccaggctgatcttgaactcctgacctcaagtgatccgcccacctaggcctcccaaagtgctaggattacaagcgtgagccactgcacccagcatttcatattccatttcatatttatttcatcatttcatctccttcatttcatttcaaaacggagtctcactctatcacccaggctggagtgcatcaccacacccagcatttcattattcatttcatttcattatttcttcatttcatttcatttcacctggcatttcattattcattatttcatttcttcatttcatttcatcccatttgagatagagactcgctctatcacccaggctggagtgtgccactgcacctggcatttcattattcattgcattatttcatcatttcatttatttcattttttcatttcatttcatttcacccggcatttcattattcatttcattatttcatttcatcatttcatttcatttcattttgagacggagactccctctattgcccaggctggagtgcgccactgcacccagaatttcattattcatttcattatttcatttcatcatttcatttgatcatttcatttcatttcaagacagagactcgctctatcacccaggctggactgcgccaccacacctggcatttcattattcatttcacccagcatttcatatttcatctcatcatttctcatttcatttatttcatttcatttcaagacggagacgcgctctatcacccaggctggagtgcgccaccacacctggcatttcatatttcttcatttcatttattccattcccatattcccattcccattcaatttcaatccatttcatgacagagacttgctgcattgcccaggctggagtgcaccacacgcatttcattattcatttcattatttcatttcaccatgtcatgtcatgtcatgtcatgtcatttcgagccagaggcttgttctaacacccaggctggagtgcagtggcgcaatccctgctcactgcaacctctgcctcctgggttcaagcgattctcctctctcagcctcccaagtagctgggattacaggcacccgctatcatgcctggctagtttttgtattttagtagagatggggtttcatcatgttggccaggctggtcttgaactcctgacctcaggtgatccaccgtcctcagcctcccaaagtgctaggattacaggcgtgagccaccgcacccagtatttcgtatttcatttcatttcatatttaattttgtttcattatttcatcatttcatttcaagacggagtctcactctatcactcaagctggagtgcatcaccgcacccagaattttattattcatttcaatatttcatttatttcttcatttcatttcatttcatttcacccggcatttcattgttcattatttcatttcatcccatttcatctcatgtcatctcatttcatttcgagacggagacttgctctattgcccaggctggagtgcaccactgcacctggcatttcattattcatttcatcatttcatttcatttcacctggcaattcattattcattttattatttcatttcatttatttcatttattctcttcatttcattccatttcatttcgagacagagacttgctctattgcccaggctggagtgtgccaccacacccggcatttcattattcatttcatcatgttatgtcatgtcacgtcatttcattctgagacagactcgctctatcgcccaggctggaattcagtggcgcgatctctgctcactgcaacctgaggtcgggagttcgagatcagcctgaccaacatggagaaaccccgtctctactaaaaatacacaaaattagccgggcatcgtggtgcatgcctgtaattccagctactggggaggctgaggcaggagaatcgcttgaactcaggaggcagaggttgctgtgagccaagatcatgccattgtactccagtctggccaacgagagtgaaactctgtctcaaaaaaaaaaaaaaagtgatggtagatgctcacactggcaaacgttagcaagtactagaagggtcatttggcagtagtcattcacgttttaagcatgcagataatttgctcaaataacttaatttttagcaatttatcctacaactaaaatgtatgtgcaaaactgtatgtacgacagtgtttaagagaaggcctcaaagaaaaggtggtatctgaacaaagatggacagatgatgcagcatttgaggtaggtatctggaaggattgttctaggaaatggtaacagcaagaataaaggccctgaagtgggagttaaaagacaatgggaataggagtagaatctggagtcatcaaagtggcaagggagcaaattacagagaagatagagccactttaaagaatctggcttggcccggcctggtggttcacgcctgtaatcccagcactttgggaggctgaggtgggcagatcatgaggtcaggggatcgagaacatcctggccaacatggtgaaaccccgactctactaaaaatacaaaaattagctgggcgtggtggcgggcatctgtaatcccagctacttgggaagctgaggcaggagaatcgcttgaacccaggaggtggaggttgcagtgagccaagattgtgccactgcactgcagcctggcgacagagcaaaactccgtttaaaaaaaaaaaaaaaaaaaagcaaaaaaaaaagcttaattggattttgattgctaccttctaaatatcagcactttcatttaatcataagcctcaaagggtttataaaacttctaaagagttaagtttcataattctcctaacgagagtctacacatactgagatgttaatgcagggtttagaaactgtcaaaaactttcataagaccctcaaagagatctaggacaattcctcccacccacagaaaagcaatcacccaaacaactgagaatcagtggcaaaaaaactctcctaaaaggacacagtactatggggagtcaaaaacaattcagacagctgggcacagtggctcatgcctgtaatccagtaactcaggaggctgaggtgggaggattgcttgaggccagcctgggtaacatagcaagaccccattgctaaacaaaaaaagaaacaatgaaaaaaattagctgggtgtggtggcatgcacctgtagtctgaaccactgggcaggctgaggtgagaggatcctttgagcccaggagttcaaggctgtagtgagccatgatggcaccattgcactttagcctgggtgacagagcaagaccccaactcaaaaaaaaaaaaaaaaaaaaacaagggaaacattttagtgagtttagtcttgcctggaagagacaagtaagggacagatgggggcagtggtgagggagcccaggacagctagctgctatgctattcaaagtcacatatattgcttccacaatataacaaaacagagaaagaaaccaccaaacagcaaaccgtcttctagtgatcccatcatttttttttctttttttttttttttttttttttgagacagagtttcactcttattgcccaggctagagtgcagtggcgtgatcttgcctcaccgcaacctccacctcccaggttcaagcaattctcctgcctcagcctcccgagtagctgggatttcaggcatgtgccaccacacctggctaattttgtatttttagtggagaccggatttctctatgttggtcaggctggtctcgaactcctgacctcaggggatccacccgcctcagcctcccaaaaatgctgggattacaggcgtgagccaccgtgcccagctgacccaatcatctttcacttcaaccttttcctcaccatctcttcaactaatacttttcctggaccattttgactttaggcttctacctccaatctattttatctacccactacttctaacttaatcttcctcagagataattctaatactctgtccaaaaacctttgatgacatgctgcctttctatgtaattttaagcttcttaccttagctttccatgccataagcctaaactatcttcccagacttttctcccacaccttccttatatgtatcgtataatcaaacagatacatcagaaaattcagtccatccttaaggtctggctcaactgttatttattacttctttcccttttctagaaattttcctgatttctctgtcctggaggtaatttggtttggtgagaaagacaacgggctttggactcagactagagtttgatgcactagaacatgacagagctgtgtgagcatgtggaggtaatttaacttgtctgaattttagtttctttgtctataaaacaagggagtaccagtctactaccttcagagaatggtaaatgagctgacctatataaaggatgtgacctcctttctactttaagcgtattttgtacaatttttagcggagttaacacagctttcctcttggaagtcaacagacaatatgtaagactgaaaagtcaagaaaaatcaagataataatattatttaaaaacatgaaaataaaaaataatgaattaaagcagcctaggcatggtagctcacatctgcaatcctagcactttgggaggctgaggcaggatgactgcttgagcccaggagttcaagaccagcctgggcaacatagtgagaccccatctccaaaaaagaaaaaaaaaaaaataattagctgggtgtggaggcgtgtgcctgtagtcccagctactcaggaggctgagatggatcacctgagcccaggaggtcaaggctacagtgagccttgattgtgccactgcactccagcctggatgacagagtgagactctgtcttaaaaaaaaaattaaaataagctgggagtggtggctcacgcctgtaatcctagcacttgggaggctgaggagggtggatcacctgaggtcaggagtttgagaccagcctgaccaatatggtgaaaccccgtctctactaaaaatacaagattatttttagtacaagatcttcttaggattatttcctggacagtatatagtgatgttacaaccccagtgatttaaagcagatctctcaaagcaaaggaggaatgagcttttgtcaggatgctagtggcatgtccttagtattagaggaaaacaaagaactagattccttttgtttgcccccaaatcctttaacctctgagacttactataaatgatttacctgtttacactatgtcattgtgttctctctgggtaaggctcttaaggccttccacccaactgaatcaggcccacccagattatcgcttacttaatgcaaattgtattgaatgtggctaagcacagtggctcatgcctgtaatcccagcactttgggaggccgaggtggggagatcactcgaggtcagtagttcgagaccagcctagccaacatggtgaaaccctgtccctactaaaaatacaaaaattagctgaacatggtggcaggcacctataatcccagctacttgggaggcagaggcaggggcatcacttgaacccaggaggcagaggttgcagtgagccaaggtcacatcactgcactccagcctgggcaacagagtgaggctttgtctcaaaggaaaaaaaaatgcttattgaatgcaataagattaactcctttacttgtagactttgatcacatctataaaatactttcacagcaatacccgaattagtgtttgacagaataactgggggctgtagcctagctaagttgacattaaaaaaaaaaaaagactatcacaaaactaaaggtggaaacaatccaactattgataaaaaattaacaaaacatttgccacgatcacacaaaggaatactccttagtaataaaagggatagaaccactgacacattaaaaaacatagatagatctcacattacgctaagcaaaagcagcaagatacagaagtgtgtatgacatatatttacatgacattctaaaaaaaagaaaaaagtaatttataatgaaaagaataaaaattatggttgtttctggggttggggactgaccagaaaagggctcaagggaattttctgaggtgatagacatggtttttttttatgtcttgataggggtgtgggatataaaagcatatcaatttgccaaaactcaccatattatccacttaacattgtatacttcaatgtgtgtaaattttacttcaaaaataaaagaactgtaaacaagtaatgaactctatttaacaggtttactttttgcagtggcatggtttagaagttctgaaatcaccttttgtatatattaggcttaaacaaatgagaaaaattgaagatattgggaaccacattcttcattgttggagaagagagttccaattatggaaagggggaaagactataatataggctgtgatgctggttaagaatgggaggtatcaatataaattcacagttgtatatgtgtgtgtgtgtgtgtgtgtgtgtgtgtgtgtaacatatatgttctagttcaaatcttggcttccaaaactaactaaaatccaggaccacctgcagaaatggctgattccagagctggtgcagggaatatacaagatgagcctacaacatctttttgtgctaaaaagatggagatgctcaaagaagaaagtgcattaaagaatgatgggcacatgtcaaaggcacacaatagttaacttgaaggcattcccactgatggaatatgggacaatttagcaccaaacagaaaatagcaatggatcataatccactgaatacaataagaatgcaagtgtctatacttgcatatatattaataaataataaatattaataaataagtatacacaaataaggaaaaagggaaaattcttccttatagtagaatgccaactactaaatgtagaaagaatgggagtttaaaaaattagcaatgactgctaaaattagtaggtgaaggttttatgaggacaagatgtttacagtttcaaagtatataaaatatatagcgatacattaattacagaatgaaaaagtataacctgacagtggaggaacctggtcaacccaacttaaccaagtcattacactggtgtcacaaatattgggacaaagtgctatcacatgtctcctcaaaagatatactaaatagaacacagtatcacttcagtgggattcctaccgaaatgaataacctgaacctaattaggaagaagcagtgggcaaacacaagaaggacaatctacaaaataactagcctatccactttagaaatatcaaagtgaacaaacacaaggaaaagctgagaaatggttccagtttaaagaataccaaggtatgagcctggactaattgaagactggaaagaaagctacaaaggtcataattggaataacaaaattatattataatatagattaactaacagtactgtatcaaattaaatttcctgattttgataactaactgtgctgtgctgatgtaagacaatgtcctagttcttaggaaatatacaacaaagtatttagggataaaagggcacagtatctccaacatattcctaaacaattcaagaaaagaaaatagagaaaatgatgaagtagatgggacaaaaatgtaaactggtgaatctgagtaaagagtatatggaaattccatgtattattcttacaacttttctgtgaatctgagtaaagagtatatggaaattccatgtattatacctgcaacttttctgtaagtctgaaatttcatatacatacacataaaaacacgtaatataaggccgggcggggtggctcatgcctgtaatcccagcgctttgggaggtcgaggcgggcggatcacaaggtcaagagatcgagaccatcgtggccaacgtggtgaaaccccatctctactaaaaatacaaaaattagctgggcgtggtggcgtgcacctgtagtcccagctactcaggagaggctgaggcaggggactcacttgaacctggagggtggaggttgcagtaagctgagattgcgccactgcactccagcctggtgacagagtgagactctgtctcaaaacaaacagaaaaacacacaataaaaaccacataatataaataaagctatgaaaatactctattttcatatatgattaaaaatttccagaatcaaaagttccaagatttaaactcaatactagagtttccagtctattatttaatatactacttctaaaaataatttgtattttaattattagacatttatctagaattttggacaagatattcatgctaaaaatcaagaaaataactagaaaatttatgttatttcttttatgaagcattccttgacaccataagtagggttgattgttcttcctccatgctcccaaggtattttgcacataacattggtagagcacttagcatattgaattgtaatctgaaaatcaattgcatttccacatagtagcaatgaataattaaaaacagaaattttaaaaacttacaacagcaacaaaattatgaaatacggataaatctgacaaaatggggaagaattatacaatgaaaaccataaaatactaatataaaatactagtgagtaaaactgacatgaataaacagagacatacatcctagacatgtgtcaaagacaaaacattgttaagatgtcaattccgaggtgggcggatcacctgaggtcgggagttcgcgagcagcctgaccaacatggagaaaccccgtctctactaaaaatacaaaattagccgggcatggtggcacatgcctgtaatcccagctacaagggaggctgaggcaggagaatcgcttgaacctgggaggcagaggttgcggtaagctgagatcacgccattgcactccatcctgggcaacaagagcgaaactccgtctcaaaaaaaaagtcaattctccccaaacagatctacagattcaaagcattctcaaaattcagcaagctgttttggtaaacattgaaatactgattctaaaacttggcaaaatgactctgaaggagaaaaaagttgaaggacccatactacctgattttaagacttattataaagctatagcaaccaaaacaggaagaaagaaaacaacacattaataagcttacttcaaaacttaaaacttctgtgcttcaaaagtcactgtgaagagaatgaaaagacatgctagaaatatctgataaaggatttatatccaaaatatataaagctttcaaaactcaattaaaacaaaaaacaatgaaaacttaaacaaaacatagcttcatgggtgtagtcatacgtccaaacttacataattgtataaacaaatagtttattttatgtcaattatacctcaataaatctgtcttaagaaatggaatctgactccctcactagactctcagctcctcaagggcagggattataaattataggcggggtgtgttggctcatgcctgtaagcccagcactttgagaggccgaggcaggaggactgcctgagcccaggagtttgagaccagcctgggcaacagaatgagaccttgtctccactgaaaattaaaaaaaaaagttaggtgggtgcagtggtgtgagcctgcagttcctgctactcaggagtttgaggtgggaggatcccttgagctcaggaatttggggtaacggtgagctaggattgtgccactgtaccctagcctgggtgacagagatcctgtgtctaaaaaaagaaaaaataaataatatttttatctacattagcatcttgtaatgcaagaatataaaagcagttgagtaagaacttgccgaataaacataataattaatgagccaaagaaatttaactgatgattaaaacaatgagtccagaaataatccgaaggcactacataactgacgcatactaaaaattcacatctacaataaatgcatggtatggtaaaaagagcactgcactgagattaggaaacgtgagaaactcaaagtggatcttcactagctaggtgaccttagataaccaaacctcactggacatcattccatcatctgaaattcagggttcttaataattcttattttgtttacatcatagaattccttgggaaactaaataagacaagtaaaaaattcattcaaacccacaaagccatcagtattggtgtcattagaaataaattttttaagggggtagagaaaccacagatacgtgattctatttactcgagggtgaaaagcaacctggtctacttgcctgataggaaccaagacagcaaggactactccttcttttctgttttctgcctagcggtagacaagcctcgtttttcctgttcataaaaagacaaactgcctattctgatctgttaactcggaaaacaaatacttgttctgtctttttaaaagaaagtggctgaaaaatataacatatcaattatcatgtttctacttcatgttaatatagtttcagtgttcttctctgagaggaacaaggttagatttacttccttccctccttcatgggaaataaaaaatacacatacaaacacttttgtactaaacaagttaaaccctgggttttctaagtagacaccttttaacatgccaactgtctccttcgaaaaaagtgaatgcccttaacttgtttaaaatttaaattaatgaactatgatgaaaatataaaggtaaactggtaacagctactgagacagaagactgaatgacctttgtgatagctctcactagggatgggcctttaagacttcatagtcaaagaccttcacttaaggaaaaaactagaaggaatccattaaaatcttatgaggaattcatgacctcttcatgattttttagatttagtagtaagaaacatggttattttcccttattaggaataagagtttgtaacgatcatgggaaaaaacattcggagattaaaaaaaattctacttaccaatggattgttcccttggaaagcaggtttatataaacaccattttacccaaattttattagcatcactcaaacagtagtgattatgcagtaaatagaaaactcttgcttttaattctaatgattattaaaaacttagaaaagacaagcataaaaacgtttaatttccaaacatttttggaaaactccaactgaatttggacctttcccaatgagctggtgtcttgacaggcacctctagtactttaactctagaagatgtcaccagtactataagcaatggtgtctacttgttatcatttctatcagctctgctgacatttggaaaagatgtaaagatttgtgatgtctgggataatctgattcactagaggcaggttttacgttaaatacaggaatactctgcccagtaggtttcatgtctaggcacctggtttatgtgctcaccaaacagaagcagaaaaacaactctcagaaaacttaacaccctttagtattgaaactattttctggatgttgtacagaaacaagtaagagaagacaaaaaaaaaagaagaaatgggaagattggaattttaactctttccctctatctatacttactgaaaggtttttaactcatggctgccccaggcaggatcacaacaaacagagggataacactgtctgtataaaagtatttgcctgtttgcatgacctgtttcatattcttttaaaataatgataccaaccagatgtcccacaatgatgataaatttaatttatttccaatttctcaaactcttctacagattcaggcagcacagtcacagccattagctcactgagctggatgcatcattgaaggaacagaattgatcaggcagatagattgcagtgcatggctaagagtctcctaaggagggagatggcagaaatccagacatcaaatagatgatgaaatggccatttccattaaggtaacatcacatcacagatattaattaggaggcactataataaagttaagtggatgtggggggaaaatgctgagttaaaagtcaccccatatgtccttagcctgaggtaattacagatctgaaggtgagtcatggatctgcaattttccattcattttacaatagctgcaggaacgtttagagattacgtaaaaggagattagaatccttttttagactggggacaaattatctttaaaaaaagaaaatattcttatgttttccttttaacattcctgttttattcccaaggaaaatgacatcctttatttacattaacattaatggaggatgacaatgtactgactactttcttcttcttcttcttcttttcttttttttgagacggagtctcactctgtcactcaggctggagtgcagtggcacaatcccggctcactgtaacctctgcctcccacgttcaaaagattctcccacctcagcctcctgagtagctgggactacgggcacacaccaccatgcctggctaattttttggatttttagtagagatggggtttcaccgtgttagccaggatggtctcaatctcctgaccttgtgatgccccctgcctcggcctcccaaagtgctgggattacaggggtgagccacctcgcccagcccagttcttactactttctagagaaattaagcaaatgaaacaagttagctttaagtttaaatgcattttaccaagttttttatttcaagaatgtaaattcatcttaaaaactgatgggatattttgttctcagtgttcaatccaaatctaccttaagagctaaaaaaaaaaattttttttttttttgagacagtctcgctctgttgcccaggctggagcacagtggtgcgatctcggctcactgcaagctccgcctcctgggttcacgccattctcctgcctcagcctcccaagtagctgggactacaggcacctgccaccaggcccagctaatttttttttgtatttttagtagagacggggtttcaccacgttagccaggatggtctcaatctcctgacctcatgatccgcccgcctcagcctcccaaagtgctgggattacaggcgtgagccactgcacccagccggaataacaatcttttaaagtattatttgatgtacgtaaatgatgaagacagccatattccaaacctgcagagcttccctacaatagtatgagaccaatagccaaagtgctggttgctcaacaatagatttatgccagttttttttgttctgtaattccttgcaatcttatctcccctagtaccttgcccaattatatacctcccacgtgcatccatgataactaacaaatgcagacagatggccaaaatgtgagttgaggaagtgttgagtacaaaaggagtttatctttccatttcagtataatttggatcataatctcagaattctgaatgcagtactccaagtcactaacttcaaatggctgactgaggctctgtccaggaaaaaaattcctttgcggaagttccaatcttaatttcctacataaactcagacaatttacaattttttattttttgccttacttcaccaaaaaagcagaatcacagggataaaaatttacataggatgtctaaatgatgtagaataactcattgaaagctcctttatccacgggtgcttacaaaagataaaaagatatcagtaaaaaatggtgcagtaaaaacctctgaaaactctctcctccatgaaagcaatgtgaacactgtgatgagcactgtgagaatcaactgaaaagtagccaaaggcttgcagcaatccagggagtgcttattcaagaaaaaccagctgaatcttggtaaaaacaataaactttgcagtgttttatttgccttattcccatcccactctcccaagctccatctcggccttaaaaactaaccttcctgaatcacagtgaaaatcagaagccatcagagggggcaaaagaaagctgaagctccttcaaagcccaattctcagagaactgtcattatttgacctgtctggtggtcccctggagggccccgctcagaaggctgtctttactttacaggacttggagcttggccagtaggaaaagcataattcttttgagggtttgatgaaaacaattacagggattgtttaacactgaaacttcttgaggtggtggcaaacagctggggcaaacaataggctaaccaaaagcttcaaaggaaaaactgaagaatgagaatgtccacaaagggctttgaaaagttctaatatattaaaacaagaaggaatctagagggctcatgcgtgcccatggccatatgaatgctcaggaaaaactagagaaagccctcagctctctcctctgcctgaccttgacaggaagtgaaggctaaggcagaggcatcaactgcttagtgcagtgttgaaggtaggctgcacctgcacatacagcccttcaacaaagactattagacttcgttgagacttattagtttcaggcatctaaggaaatctgttcaagcattagctgactactaatctaacaagcagggacttcactggccacacacagaaagaacacagacatcacaaaattagtttagaaaagtcattgaaaaaacagcaagaaggatgaactgtgatgaaaagagaaaatctgatttccagggtcacattacattattttaaatgtccagttttaaatgaaaattagaagacatggaaagaaatgagaaagtatggcccatactcaaaaaaaaagcagtcagtagtaactgcccctgaggagcccagatgttggacttagtagacaaagaatttacatcagctatttaaaatatactgaaacaactaaagaaaactatgtctaaaaaactaaagtataagaatgatgcctctcaaatagagaatattaataaataaagggatagaaattataaaaaataaacagaaatttgtaattgaaaagtacaataactgaaataaaaaattcaccagtgagattaaaagcagtttagagcaagcagaaaaaacaaccagtgaacttgaagacagggcaattgagactgagcctcaggaacaagaagaataaagaatgaagaaaaataaacagagcttctgagacctgtggaacatcaagtgaatcaacaaacacgtaatttgggagtcccagaagatgaggaaaggggaagaacaaacatttgaagaaataatggcccaacatttaccaaatataacaaacattagagaggttcaaaaaacttcaagtaggataaagtcaaagagatctgcatgtagacacaccatattcaaaccattgaaagtcaaagagaatcttaaaagcaaaacataagaaaatatactcttctgaaggttgtctacaaatctatctgaggcacagtgtggcttcaagattagactttggagtcggttttgtcatgtatgtctttggaggtaatgcggttgggtacacattttatataactcatggggaaggtttttctcctattataatttttgggaataacaataaactaaattctacaacccaggtgagtgtttagaccccgaaactcatctccaagcagtaacagattctaagtggaaataaaaaatccactttttcaggaaaaaaaaatagtaccagcaactcatggtgcattaacggcacttatgtgggaatattcttttacgtacttgaataaaagactcaacttacatatggtgcctgattaagagtttcttaagagatatgaggtaatcatcatttttcttgatagcttattcaaagaaaatactgttacatagtgatctcagtctgaagaaacaaaaaaaaattaaatctctataacagacctaaagcatacacgtgactaaatttcccccctcctcctcccatattagcgtaaagaaatcaagaagaacaagaagaaacaccaagataatcagacttttttttttttgagatggagtcttgctctgtcgcccaggctgcagtacagtggcgcgatctcagctcactgcaacctctgcctcccgggttcaagtgattatcctgcctcagcctcctgagtagctgggattacaggcacccgccaccgtgcctggctaatttttgtatttttagtagagacggggtttcgtcatgttggccaggctggtcttgaactcctgacctcaggccatctgtctgccttggcctcccaaagcgctaggattacaggcctgaactatcgcgcctggccatgataactgaactttttcttttaggattcaaaatagggtaaacaaaaggttactgatttctctaaatactgttcctatgcttcttatatttacacaatgtcttcatactaaagtacaagaaaccacttgaaaattatttttaatagaaacaaatcactctcaaatggaagaattacaacagaatacatactagaggcatatcactatgttcttcttaagagcattattatgtcataaaatttcaaactgccaagcgtggtggctcacacctgtaatcccagcactttgggaggccgaggcgggcggatcacctgaggtcaggagttcgagaccagcctgaccaatatggagaaaccctgtctctactaaaaatacaaaattagccgggtgtggtgacgcatgcctgtaatcccagctactcgggaggctgaggcaggagaatcgcttgaacctgggaggaggaggttttggtgagccgagattgcaccattgcactccagcctgggcaacaacagcaaaactctgtctcaaaaaaaaaaaaaattcaaactgtggggtaactgaatagtttttaatccctcttcctcagataaagatgccacgaaagaaagaaaaggtaaaaataagatgtcttacttaagattaggaaaataaggctgtaataatttcaaaaactaagtataaattaatggataaaaatattgggactgatgcccatggaagataaaagctatactgggtagtctctagtcttcatgacagatattcacagatggggaagactaccccattttccaggcttcccaaaactaacctgtgataattagacattcattgtgatccagcacctcagtgaagagccgtgaaataatcaactcaggattgattaaaaagcggatttcttcttgcacaagtcctgcactggttacaccacctccaacaaaatgatttgcaaaatccacctgttggggaaatgtgacattaaataatggtcaaaaatacctacacatatgatcaagaagcacatagtctctaagctctcatcttttcctctcccatgaaaatcaatccccaaataagtaatcttcccaggaagggcagattttggttgcttaagctctttccacctcactgcagttaacatctctgcacatttttctggatcccagaaccagagaagcaatctggaaaatggagcttttaggcaaaatattatgaatcatacagactcttgtttataaacctatttgtgtctcatgggccacaaatcaagggaggtctttatctgggaaggtttcaaagtcattctcccccattcactactcaacttccctttatgtatttcacgtgactttaatataattaaacttttcttatgtaatatggtaaccaaacacttgccctaaagaactgaaaagtttagtaatcaactttttgggtaaccttttccaactttattgtaagaataaagagatcgaatttttgtccttctaaattcaaccccaaaccccaaactacatgaacattacaaactactttttaaaaatataactaaggaaaaaaggaagaaagaaaacccagtatagcaacaaagattcaattaaagtaatatttccaattaggttggaaactcttaagctttatgtggagtagtatgatgggatccccaaatgcctactaataaagaagaattacacaatcctccagagaaagcaaactcaacttgctggcattatttccgtttgtccagtgtgtccagcactatgccagcctcatgaagcagtatgtaagaaatagcaaccatcttttccttagtgagactatctgaggagttagatcacacacacacacacacacacacacacaacttgtgtatatacatagtcatacacacaagtaaaataggatttactaaataccatgaggcttatattctttcaaactattttaaaatatacgatttcttaaaacttcagtgttctctaaagcaactgatactaaatgacaatctgaagcctattttacaaaatagtaaaacaatagtatgaatcgtttgatatgtaaaaatatatgtcaaaagacagaaattaatagaaggcgaagcagtcttcttttaccacaggagaacttagaaaatactaaaacataccactgaggagttcttcaattgagctaccagagagaatcatatatttggatttgtgttctggagtactaaaaccaatgctaaaaaaccagagtaactctttagcttaaataggaaaataattttggtgaaaccagtctgttgattagaattagctacctactacatatgaggtctatgggcactgggtgattcatggcttaaactgtccaattcaacaactatttactgagtattgtgctgggaatcactggatacaaagatgaataagatatgtatggttcctggcctcacggcatttgcaatttagatggcagtcagaatgagcataagcagaatgagaagatgattattgaagagcttgttactatgtatttgatactttctaataatacaattaactaaaattggagcatgggaggaagataggaaagctttacaaggggatgtggcagctgacatgcaggctgagggcatagctgcacaaggacacagggcaaaaaaaaaaacaaatgtaaatcactgtatgaggggaatggtaaacagattcattgtgcttgcctgcagtgtagagtaggtggaggcttacagttggtgatgaggtggtctgaggtctagggaatttttactcaatttccctctgaaggttctgggaaagattcaagtaacacctggacctatgttttaggaagataattcaggctagagtttaaagaataaatggaaaactgtaaaactaaaagtaaaaatgctggttaggtgagtactaaatagtttatacaggcactactagggcctcaaacaggaaagtggtaaagtaaaggaaagagaagaaactcggtaaagaaataaaatggactgtacttgagaactaagagactggctgagtgcctaaaagtataatgatattgtgactacaaatgagaaacagatgaggtttaagattggcctaacttaatttttactggaataaggtacataacaaaaataaaaagataagctctatccaacttatgtactacttgataatgatgatgaaatacattcaatgtgtatgttattgtttactctttgaataaaaggcccacatttttaacttgaaaggtgtacacagaaataaagacactaaactcagtatgcctctaaatgccagagtcttttagaaaaccaaagttttactacttaaaaaagttcttaacaataaagaccctctacaacagttgagagacctgttccagtacatgaaaacaagaatgtgaatgcatccttatttttagccagttattttccaagtcactttaaagctactcattcagattactcagcttctgaattataacttgatgaaaagacaggaatgataaagctcctcagagaggttttgttgttgtggccattcagcatcatgtaatttatatgctacacaaggagctctgtagcattgcaatacaatattccccgatctcctgcggagacatggcatgggtagggagaacaattaatagaaagaagcccttacggtattctctaatctaccgaggtctcacatttccatctataatatattccaaggaagtggggaggatctcaaccttaactgttgttaaataattccttgttgaattgtattgtaatgaaaggtcagcattcctgtggtgctaactagcagtaactttgtttagttcatgtgtattaagaatctctcagtttatccaagactttaaagatggaaagaacttcatcaagaggggaatgtgggggaaaaagtgatactaatttgaaccaatatttaagcatattttaagattattttttaaacagaaaaaaggtataggagtaaatgcaaatttaaatatgttttgtttttgtttataagctcaaataaccactgggagaaggtgatttagaataaaacatagtttgtctctttgaagattttaattacaaatatgtccaaataaaaggccatttaaaaaagaatctcagtttcatttaaataataactagacgtaaattttatagtgagcattaagttattcaaacaaatcagtccattttcaggcaactgctttctttagattctgaaccaatataagcaccaaataagaatctaagaagaaaaataaactattatcagtataaatgagatggtatacaagcttctttcaaagaaaactcagtttacaatgctcttataaatgggataagaacacaaaacactaacattagtgaattttaaagaagcattataaatcaaaagattaggttagatattactatattttaaacacggggcttttgttaacccccttctccaaaaatactttttaaaggtaaaggcggtaacagattattaacaaagattgagaagtggaccagaattacctgcttttaacagggaaaagacatagcaaacagctagctcacgtgcgtgaaactgttacatatgagagagaggcctttcttatcaatcagttttagacgtctgccccctcaacctaaacaaagctgttggtggcagaaaaacatctccatctggtcatcaactggggcagagcaagaagagcctttaaggaaaaagaataaaaatgcctggtgacagtctgtcaagactataccctgggaacttcctccactgtcaacctactatcaatgtctgaaccaagaggctgatgctgtccagatcttgggattttctgtcaaaggctttttagagaagcacatataagaaacagagagtatacactggcaaatcacaacattaccaaggctgtcaaagtgatctgtttggtgtttttcttcattctgctatcatgcttctttgcattaaatcagtttaggagacaaataaacagtttttcaaatttcttttgctgtcagaagcttgacaagaaaaagtcctaaccatacacagacactactaagattcacctacctgtagcatgcctcggccattttcttctatggtaccttcgtaagtgacatgcaatcgtgtcaagggtttttcacatctacaatataaaaagacattcccttatttattattttaatgacaagttgttcactgcggacaaaagtgaaaatataggtaactattcaaaaaccgaaaccaccccaaatctcgaaagtcagaaacagatgcctactgttaacattcttggtattgatcctcctttattcaaacatgtaaatatacatatttaaattaaaattggataacatagtttgaaacctgattttcctctaaataatatgaaagtttttcttctttaaaacagttgaaaaacattacaaaatattaaaaaaaattaagatctatgaaattttgttatggctagagttggcaatctgaggaaaaatgtagaaaaatttggcaataaatcatatatgattctcttctggcttccattttctattttcactgtttcataaccgtgtgtgtgtgtgtgtgtgtgtgtgtgtgtgtgtgtgtgtgtgtcttgatgaaaatacctgccacagaaattctgaacaatggtatttttctattaataaggttaacagataaacttagtacctgtaatttagaaggcataattattttctttccctttcaaccatggccactgaggtatttacttgacttatgttatattaacaacaaattccattgtattaaaagtatttgttaacattatttgccttattagatatttttcccctgatcacttactgaataaaaaatataaatgaatgaaacagaggagatccaaagttctaactcacataagagtgcccataatcttttttgggagggaggagatgattatatttttagaaaatagtctaggaggttagctggaaaagtactgagaattgtttgattccttcctggtttcaatgagtttaaatacatttctggcaaaactccagcccaacaggctgatagctttaactcagaaggtaattctgcacaggttctgtctaagagccttatttgtattaactcattgaatcctctcaacaaccctattactatctccttttatagacggggaaacaaagcacagaacatctaagtaagctaaccaagactagtgaaataaagcagcagagatgtgaaactaggtagactcactcaagctctgaatcagtatgctacacttttagaaaaattactttcccagtctcttgtagaaaacagtacggtaagtttgatatatttttttaacttcctttttttggtcctactttcctagccattttattcagaggaagacccctgtaagcatactactaaaaagataaagaagcataatctaaaaatctctgggctgtcagtcaggacttcagaatgggaattccatctgttgtcaactattctccatgactgaagctagaaactttatagtatagctcttaataaaatcacgaaattgctagaaactttttcttggttttgttttgaagcattttctaacttcccagtaggtcatcctctacacccccgccccaggagtcagagacgtaggtgattctggctctctgtgattaagcctggctaaagtatttgctgataatcaaagggttaactataacatgccagaaacatggaattcaggaaagcctctaagttcctggacccatttagccccttacgcttgggaacaccaacaatccttatcttttcttcattctccctctttaagtgaatgcatgtttctggttctgtggagtctgggagactggttttaattatattctccaactcacttataaagcaactaaaacaaaaaagagatcaatgaaataaaaataagtcaaattctgcctatcaaaattaaggggacaatcttcgtctcacttagaggcaaagttactgtgtctcattgacacagcagccttgccagtctctgcattttgacctgtcccttctctcccacatggtggtatacaaatgggtgttctttcacattagtgccaaatgaatatcagatgcaaagtagagatcctggatgacttaaaaataagccctcagattgatctataaaatctacaccaaagtaacaggaacaaaacatatgcattcctattagagattaatagaagagtgaagaaaaacaatcctctgcaccatagagatgacacagcagaatggtacttttaattccaggtactatattttaagagggcccaatgaatgggagtatgttaagagcagagataaagggtttagaatccatattacatgtgaaatagaagaaacgaatcagtttagtatgaacttgtatgcactgttagagagggaagtaggttaagaagccattaagatacatgaaggagggtcaaatgttaaagaaaactagaaattcagatttatttatgtagctccagaaggaagaaccaggaatggtggagaatgaatgtagaaaacatttttagtgaatgaaagcatgagatgataacacaagcagccaccaatggaacaaactgatacgaaacagcggatctgccatcactgaagctatccagtcttctgtctgttgcaggtattacagagctgatcaagagttttagcaggcggctggggttcctttcagatctaacatgccatgatgccaaaatgctgtacatgttctcatctttttctggctcatttttttttctctcttcaggtcgcttaaccttttatctacttccctctattaataatcatctaaaccacgcactcagtcttctgaagtaaatttctttatctttcacttcacaaataaacatctttgatggatgaaaacactgcaggaaagccacctaagcagatatgacttctcaagttaacgtttttttaagtgatttccattcatcactaattccaaacaaaacaattacaaactatcataaaattattagaaagtgaaaatgggaggcattggttaaatatgtatttagtatgcttcatcatgtcctcaaacatatttaaaaagttaatctacacttctttaagtgtcctgggggacttgctttagattaagaaatatgttaactatttcaggacccttctttaagtatattgggagacttgctttagattaagaaatatgttaactatttcaggacactaaggactttacaaatctgaattagctcatattggctgctatctcctcaatattttctgataaataagaaacaaacagtaaatagcaacttccacaaaatctaccagtagtacacaagggcagccaaacttcaaaattcttgccactcgacgaactctagatggttactgtttactaaaatgtaaataataaaaagacttttctcaatcttgtcctccagaaagaaaagccataaagttcaaacactaaccaaaaaaaaagggtaaggagaaacatttaaatattggtgttccttttattagtgtcttcacatacaacacttctcaattttaaacaggactttgtttcagaagacaaaaccaagacaaaatggtagaaatcaaagggttatagactttgatttaaaaggcataaccttttcaaacatgagagctatcaatgaatcatttatgagaagaaattccctggcactaggataaatagaggttggaaaaccatctttctaggtgctataaaatagaatcctctcatggtgcaagagtccttctatttctagggggtctaggattatttttattattgttgttacctttcccattctggaaaatcttcaagactctgtcttgtaaatgtcaccaacccagtaggttctacagaagcaataaaagaaaaacatacccaaaataagtttcaattttgaaaagattatacacacacacacacacacacacacacacacacatacacacacacactcggtaaaagaataggtctaacattggctataaaactaaccaggaaatacaaagcctagcattggaaaataacagaatattgattgaaaataatatccttacagtagaaactccttctataaaataataagacttcactaaacgaaactatacaaataacagcacaacagtaggatttgagtgctggtatttttggtaaagtttttgaagctgaatacacttttttttaaaaaaaaaagagcattgaaaaaaaggatgtataactggtacagctaatgcaataaagacaaaattgaattcaaatttgtagactcctttacaaagaaaggacttaaccctacattcaaagactggagaataaatacacatttatgtactatatggtaaagtgaaatgtcacagatttaaaaaggaaatcatttgcacatcctctggagttagtacagctaagtctcaggcttaaatagtgggcaatcactctacttgttagtagcagtcgtagccagaggagaaattactggttctaagagtttacagaacaaagatgacatatttttcaaggagcaataaatttgggaggatctaaatgaagtactattaatgtagtcaataattttagaggatgagatccttttctagtcagatttatttatttattttttcaagctagtagcaaaagaaacaaataaatcagctggccagaagtaatttgtctgattcaaatcaaagaacaaactaaaaaggccatgccgtttctgttttcttgaatacaaaaaagctcttaaggaaagagagagatgtcaggaactattagtgatgacagtgtataacccagtgaaagcctggccatcatttcattcctgtgcacaattccacatttccttgttctcagtcaaaagcaggaaccactcaaaaaccatatggagcagttgcagtagaaaacaaatttttttgttaagatgggtcttacgtcttttagatacctaactttaagataaatggataacatatttaaaactcacaagtaagtggtcaaacaactcaaacactagtgaagcaattccatgaatataatagaaaacatctctcttgtcattcggtaacttagcagagaagaacatcaaatgtccttaatatatactaagagatgctaaaagaaattcataaacactgctggcaaagcaagaaaaggcagaagaacatggtttcttagattaacaaaaatgccttgagagcacgtctgttagcgttttttcgtaacaaggcaactttcatctcagaataggatactttgattaatcaaatacttcccatcataaaatcacaatatatactatatacaggtcataaattttcaaaaacctgatctataagacactttatctaaaactatatagaaagtaatttaattcagaaggctttttaaaatacttcagtctcaagatcttcatcagatataaaatacacatgtttaacaacactgaaaagttggtcctgatggaattctagtttatcaattctaaaaggcatgttttttcacatgttacatttctgaaactggaatacatcttttataatggaggtatcttaccataggtgtagactagaggtgaattttcccagagaagatgtgcatctgcttctgctgtcgtctgggaacactatcagcctgataccatctgaattaatcctttgtggcaggcctttgtggaccacactggtggtaaggctgcacactcaaagcttagggcttgtggttcaaattctcagagaaatgtttttttcctttctctatttagtgtcaaggttgagacttgcacgtttctttatggtccctttcctggaaggtcaagttaatttctcatttatccttaggtgtaccagccttgtgggtcatgtctcctactaaactccctgtcctgagtgttttttccttcttagaggtatataatataagagcatttttaaaaagtcatctatgacatctcagattcgatgaaatatggtaccttaaataagcttctgaagtctattgagtaggctccagaacttctacacaaccactcattatactgcaacctcttttattctctttagtatttcctcttcaaaccattagctttacacactgaagaccaagagcaatgttgtactgtatttctacaaagaacttaattaacatgtacagtgaaaaagtcagaaaataaaatgtctagttataatttatttcttcaaattcccaatacttataatggcatatacatttccagctgaaaaaacaaactttaagctttttcctcaaagtatctgaaatcctaaaatttagaaagccaagttagtttttagagaagacatacatgatttgactcccaggacaaaaaagtaaactctgtactacttagttataataattctacttaaaacggcaactcaaagtactgtaaaaacaaaacaaaaaaaaacaatagtaataattctaattagacctagaatggccaaaaaaagcagtcatttatttatttttttagacagagtcttgctctgtcgcccaggctagagtgcagtggcacaatctcagctcactgcaacctccacctcctgggttcaagtgattcttgtgcctcaacctcccgagtagctgggattacactctcccgccaccgcgcctggctaatttttgtattttttagtagaaatggggtttcaccatcttggccacgctggtctggaactcctgacctcgtgatccacccaccttggcctcccaaagtgctgggattacaggcgtgagccaccgtgcctcgccttacgtagtcatctttttaacaagtcattacaaattctaatttgattttgtgtctcataggtccaaatgattctgcattttaatatttcattcagtacagggcacaaaactgaaattcaataagctatgaggtaattccatatcagagaagcatgtaattttcccttaaatatcaaaatcctgataattgatttcattctaaaaatttaacaatgtccaatagcaatacattcaagggggaagatgccaagcacattgtaatgcaagagtaaaagaaggatatgagaaaaatgaccttaaaatgattcaaagacatattttaagacaatcctatgacccagaactgaaaaaaagccatttcacttgaccaggttgaccttacctacttagcacaaaggaacttttgaggtgttctggtttacatccacttgtaggaaaggctacccattgataatagcttacatttattaagcatgtatcttcttgtttaatatctataactaccctgtaaggtaatggccgttattatattatttcataggtgataaaactgaagcttagaggtgtcaagaaacttgaccatggtcattcagcttctgagataagagtggcaataccaatctattatcagctggtcattaccagtatttgttggacatttactattactgtgttagctgctatcagtttttggggaagcaagaatgttaaggttcaatagaggaagatggagatataaaactcagtacaaaacagttttataagaactccacaaagggcttaggggggcacaaaagagaggaatgggtagaaaagcaatgcgttagttgacttatgcaaataaactagtgaatacttctttaaataaagagcatccaaaatttatttcctggtcaatatactttctctggtttttattcatgaaaatcttttgatgtatattacagatttcagagaatatgggtccgatttcagagtatgtaaaccccgccccccctacatttagcacacgtttatgcttatacacaacataagcataaaatctaggttatattgtcgcatcattactagtgtttcaatgtggttgggacaggaaggtttacgttaaacacaaaatgttcctcacatgtcacttgacttgaactgttcccatcagcaagaaaaattacagtaagaatgaaaggaatttacttttctctgtgactcttctaaagtagcagaagagcgttttaagtttctccggtttccttgatgaacgtccctcaaacaatctaaaagagataaaaaataaaagagaatggaagataagttaaaatgccttaatgattcacaaaactacatccatattgctaccaagtaatacaaagaaataattcttccagaagacaattctgtaatgataagaactggaaaattggtttagattcaaatggcatctggaaagaactgaaaccaactagaaccagacttcttcaaagctgctcaaatcagacatcatttactaccaaccacatttctccaacctatcttccaccacagagaaggcaccatccagccctcccagtcaactggggtcagtcagtcagtgcacagctactttctcaatggctaataacatttataattcataatgttactacgtagtttgataagtaacaaaaacggtatcaaaaaaaatccttatctgagtgtttgtgaggaaatgagagtggaggggaatgggggtagggacacaggcaggtataacaagatatcagggctcaacaatccttgttaaacaactagattcttttatggactgaatgtttgtgacctctcaaaatttatatgttgaatccttaatccctaatatagctaaatttggagatagggcctgtgagcaggtagtaacagttaaatgaggtcataggggtgggactctaatctgatagaactggtgtcattttaaaaagcaaggtgagactacagtactctccctctgccatgtgaggacaagatgccagccaacctataagccaggaagaaagccctcatcaggaaccaaagcagcagcaccctgatctgcagcttctagcctccagaaccatgagaaaataaatttctgttgtctaagccacccagttctatggtattttattatggcagcccaagctgactaatagagatcctttgcatggtaaccacaacagtgcctaccctgtgtcatctagttttcagcaacccggacttggattacttaattccgttttctttgaaatgatgtggcattgttattggtaacatacaattcagtttattctgaggaaagaaaagcagggctttaaaagcattatgacctgagtaagtagctcactgaaagatttctaacacaaaagcatgcttttgagcataagatctagctttccaaaggcatttaaaaattatagagactcagtggctatgaatgatgaggtactcttcatctgcctctagtcatgtgctctgactttaaaaccagagacccttcaagtaaagtccatgttaataagtgctgaaatgggtaattatttttcatgattacaacagcaagcttatgtaactacgctgagagggaaaagttaattccatgagaaaatcctattgagcgactgaaataaattaggaaaaggaaaggaaatgcacatttcaaatggttccgttttcaatgatctgaaatctgtattcagggtcaatttctggaaaaacaatttatatgaatatttatttcctaaaaagaatactaatgtatgctagtattttaaccaaatctaaaatcagatctctttttaaaaatagtttaagacagcctgtgtgataatttttatttaaagaacctatctttctaaaatatttaatacacatactcttataatccagttgccagctgaaagaaaggctctttgagggtgcaggtttcagcatggcttcttctagaatagagtttatttaagtcaaaatgaagaagccacatggcagtttaattaaacatcctatatcaataaatatgatttactaaatgaatacctaaggctccactgcaaaatctctttctaggctcactatgcactagaggaaagcaatatgaatacaaaagtagccaccaccttttcctagagatgaattgatgtactatacaattcaattaaaggataaaagttcttcttcaatagaactattgcatagtgaggagaaaatggctgttgctcttaagaaataattctctaaaacataggaaaagtgtccctagcttccatatgcggtcatctgtataaaatcacataaaaggtcacatacttcacaaccatgatgacaaattattaactttaggagcctcgtgagactgcagatttattatcctggcgagacagactttcctggaagattttatggctgttattatcacccactacaaatgaacaccactgtttattttgtaggtacaaatcttaaaggtacaaatcaagcagaatctcaatgtactctgtttattcactgctccaatcctaacttcaaatcactgtgtaaccaaatacactttcccatcttcctgatagagcagggggaagtgggggaagtgtcgtggtgggtgtcgggggtaagaagtggagataaagtcagaggagatgaagcaggtttaaaatccttgtgacaattctcagacttggctgttgtgaaattttaaagttgtatgcacagccactcaaataaaatgaattatcctgatatggaagcaagtaaaaataacataaatagacaggcaaacagcatgaatgaaagtcatcccaggagtgatatacaatctgagggacagcttttgggaatgaggaggaaaacaaaaggactgaggctggagcccaagaaacgggtgaagggggagaagaaagatggggcagggaagatagagagaagagaaaggctgatagaaatggggttagagaaagagagcatgagagacagacacacagagagaaagacatacacaaacaggctcagagaaagtgaggccttctcataatcattaagcatcattcccccgcccccactttttttgtaaacttcccaacacctttcttttttaatttagatttttcaagtcctgggtatgtatatttgaaggcatattttaagtcagcagtgtgcacacaaaccaggccacaataactcctctacatgtagggaggacatttgggcatttaattgaaagataattacagattattaaagaaatcaaacacaaaaagccagtcaggaaatcttactttgttctaaacaaaactgttggtattttcaaagacagacatcagtcaaaggtcagacacttattagctggtgtttttctttgcatacttataaggagaaacagagttgaataaaatctttccctgaatggaatactgataacattactggaattttattctaggtatatccatccccacccccaccatgacccactatgccatttcaagttaagtaataatcccattagtatacagtaaatcaaacccaaagcactacaacctccattttaaaatacgagcaagtgatagtccggaacccagccagaaagtcattcctggctcttctgtgaggcactctgccatatggccccagcagcattttcaatacagggaagaggcagatgtaaaaacctcctgggctgaccactgctgagacccacaatttatctctgaccatctagtttccatgcaaactcagaagcatcgatgctaatcacattggaagcctttatatgaatgtttaggacctgaaaggcaagcagggaaaaaggtcaggggtatttaccataactaagcagggcttaaagaacacagcaataaataaaaaagggaagacatattcaatttattgacttcagcctcccaccacatactcttaccatttttcttattcaactagctagccatacctctcttttgagattaaatacactctcacacacacaactccccactgctagaaactataatcataagtagaaactatgcataaaaggaaataacacaataaaatgctacataatcagcttaacaaatggctcatcagattacgtactggatctttcagaagccacataaaagtggggggactttcagttgtttggcatttccggagcactcagagcattttgctcatgacaggctttgagatataataaaagaacactgagtttgagtagaagacagtgatcaagttccagttgtgctaacaattcatttattctccctgaaccttatcagtagagaggcttccctacctagaaaattccatagacagaatcaaagcaagccatcaaaagacagtatcaatggtgatgtacagttgttgttcctattatttgctagcttaggctcattaaaacacacaccatctcacagtgaaaggcaagtgcagacatcctggctgcttaggattctctacaacattgtggagactaacactaggttacctgccttaattcatttttcatgttctgctatccaaaagaacatccatcacctaggaagacaagaatatgcctgatttcaaatcttcaacggaactacttaaactcttatttggtgagaatgctatttgctgcaagcttaaatccgtcacggtcactctggacttaaaaatggctttaattcatttaatagatcaataattatttctaaaaatagttctaatttttgactagtcatgaggtaagaattattaattcagttcattcaaagggagactgtgtagcagaatggttaagggacacagcttctcaaaggagactacatcctgcgtttgaatctcaagtctactagttactgtgttaacttggtgaagtaacctcccctctctaaacttccacctcattttaaaaatgagtgtaacaacaattcctaatcaatattctaattcatatggttaatgtgacaagtaaatgaatttcagataatgctgagtaagctaaggtacttgcgctaaaataaggcattacataatgcccaggccaaaaaaatcaacattcatttacataaagcagttgcattgttctaattaatattcccttcatttaaaaaaatggcccagccttgattcccatcaagcccaacatgctgactttcagcgctaaccagctcagtcttcaggataaatgaccatgtacaatgaaaaagataaacctgccatcgccaagaagccccaggcttccccactcagaaggttggctgaaaaacaaaggtcttttaaaattaaaatatataataaaattggccgggtgcggtggctgatgcctgtaatcccagcactttgggaggccaaggctggtggatcacgagttcaggagactgaggccatcctggctaacacagtgaaatcctgtctctaataaaaacacaaaaaattagccgggcgtggtggtgggtgcctgtagtcccagctactagggaggctgaggcaggagaatggtgtgaacccgggaggtggagcttgcagtgagccgagatggcgccactgcactccagcctgggcgacagagcgagactctgtcccaaaaaaaacaaaaacaaaaacaaaaaagatatatatatgaatgtaaattctggtaattggttacaggaaattggaagtcaccaaagccaagccttcccaagacatcttgacctctgcctgtcagccatccagcagcgatgggtctttgctccctacagaactctgtggattctatttcttccataagaaataaaatgctatatgctgaataagtaaaatagggtgaagtagacacaatgacaatgtgtctatggaggagtaattggaaagaagctatccacactagcttttttggaaaagcctcaaaaaatctgtgaaattccaccctcaaaatcaaattacaaaaattgtccactcttattaactttgtgttcagcttgatttctgacaactgacttgttcttccctgaactattttttcttctgcacgtaaaagtaatatatgggctgggcgcagtggctcacgcctgtgaaacaggttttttatataactgcaattgcagattccaatgctctgtgttttctctcaattctaccccaattactaacgaaatcagaagtaaaagctatgtttgattatatgtggcttaaaaataaaacatctcgtaattcctaagactaagacataatatgaaaagtaaaagacaagagactgagaacaaagggtctaaattatagtcttagcactctgccactaaccagctccattactcaaaacaagtcacttaattctcaaatatttcatctgtaaaatttcttttcattcattcaagaagcatttattgaaggcctacaatgcatgagactttgtgaaaataacaaagacagttaagatccctgtcccactgaaatgattaaataagcaattatgaagtagtctaggtagtacagtaggaaaagtaggggacagtaaaggcacacatctggctgtacaaacctaaggagtaccttggatgcctctctctgcccatctaccaatcctgtccatcaccatcactctggctaccccttcaaatgtctccacacctctgtcccctcccctacactatcccagctaccatcctctttcccggtgcattgcagtagcctctccaattgggtaaactcatgtactctggcccctctctgcttgattcccacattacagccaaaataaacttttgaaaatgtaaatctgaacacatgtgctagtctccctctacccacatatctaatcctccaatgacttcctgttgttttcagatggcctagtgaggcacagcatggtccagcctccagctacttctgtagcctctaccatctccatgctccttctcactctctgtgctgcaaccacactgtcttctctcagtctctggacatgtcaggtccttcttgcaacagtgactttacacatacttttcccctgcctagaatgcaaccacctctccttctccttggcaaaactcttattcacccttttgtacttaattcaaaagttgcgctgggcatggtgacatgtacctgtagtcctagttactttagagactgaggtgggaggatctcttgagcccaggaatttgagaccagcctgggcaacataatgagacccagtctcaaaacaacaacagcaagaaaagttatttccttgaggaaagtttcctttattaaattatatctttctttaataaaacgtcatggtgctgtgcacctctccagaggtacacacaggctagcataggaacctggagtagcaaacctatcctagcagaatctgagacaccagaaaaactgatacgtgaactgagtactggaggaggaataaaagccacgtggaaaagagaagggcatctgtgacgtgaggtttgaaaatgagacaatactacataacagtaagaactcagaaactggcttctcctttctctgtaaccttatggcacttaatacactgtggggaatattgcagttgctcattgtacatttgaactaaacattgactaaataccagtatctaaaaacaaacttacctactgtacaaacttgaaaaatagattaaaaatatgccccttgcaactaatatttatgtaaccaaggagcatattatatattaaaaaaaaactatcctgtttgctaacactaggattttaaagaaattttcttagataacattatttttcattctttgctgcccctttcttagtgttgatagtagagggtaaccatatataataacaaattatcatcaatattttaatgtttgaaggtcataaaaatataacccaagaattatgacagtctaagagcagcttatattcaagtcatctgctatactttcatctgctaaacacacaataaatgcaccgaaatgtctagtttttaagtttaattaaaaatttacattaggaactaaccagctgaattctagaattcttctcatcttaagagagtaaaacattctccaattttaaaaggctaaaaaatatggtcttcggggctgacactctgatattggagagaattgtgaattcatttctctgctgccatgtggagttataaggaatgctgcccacataaagtaagttgcattagaaacaatgacactctagcagcaatgagcacacctatcacctagatgttggtctctaaataccgttgtacaataaaagagaccaggaatccttgagaaaatggttcattccaggattgaggcatggaaaatgtaagatgaatctggaacaatgtatgattccagaatgaaagttaatgctcaaaaaaaggatagggcttatcaaaagaacataggagtcaacctaaaggagccctaatggccaaagctagaataattaaagcagtaaaataaataatactgtttaatttaaactgacacaacaaaataaatatccatgagtccattctgatattttaaaaacgggggaaaagggatagctcttccttacaatggaatttcaattagcaaatgtagaagagggaagcagaaaattcacaacaggcaaacactatggtaataatcattgcagacaagatgcaccaatggatgccaaaattagtagggataaatgtgaggcaaaacaacatttgcatagtgttttatcttttggaaaatatttattaatcacaaaaggaaatatggtaactttatagtggaaaaagtcagcagacactacctttgccaactgatcaccagtaataagaagtatcatgatcccactgatatggtgcactgagaaggacacaggatcatttctgtggtattctcccaaaaatgcatgacctcattccaatcctgaaaaaacatcagccaaacccagactgagaatattctccaaaataactgtgatgagtactcttcaaaactgtcaagatcacgaaagaaaagaaaaaacaaggaacatgttggaggagactaggtaattaaatgtaactgggatgctgggtaggatcctggaacagaaaaaggatactagaaaaactggtagaatcagactgggtgcagtggctcacacctgtaatcccagcactttgggagatagaagcaggcagatcacctggggtcaggagttcgacaccagcctggccaacatggtgaaaccccgtctctactaaaaatacaaaaattagccaggtgtggtggcatgcacctgtaagcccagctactcaggaggctgagaaaggagaatcgcttgaacccgggaggtggaggtttcagttggccaagattgcgccactgcactccagcctgggcaacagagtgaagctccgtcttaaaattaaaaaaaaaaaaaaaaaaaaaaaagtgatgctactgatcattctacttcagagacaaaagcagtatggcaaacaaaagtgggttttgtttgtgtatccgctctatgactttatctcctactctgcatactgccctaccctcagaggcaggctctgggtgaccagaggcagtgaagggcattacacacagcctgctgggaaaggggcacagattatagcaattttctcaagtctcacactgaaatcagggaagaaaactcacatattctattcatgggtcctataaagataattctcaagtgaagaaagaaacagaggtggggatatgggagtagtgagtaggagggaagaacaaacattaatttgccaagaagattctttaaaatatttttgtttgtgtagaagatagagaaagtagtcacctgggaaaatggctggaatctaaaactttatcaataccttcacactgtattaatttagtcgagcagtttgaacattcttttgtttttcttttaaaaatattacactgataaattaaccatgtctataaagggtcaaaatcacctttcacttttcatcaaaacaattacacttttcaagtctcataagacagctcatgactttagactctcattttataagacctttgtagaaaggaggacttttcctctacctttcacagtatttcagcattaaggaatataagcacaacaaaagttctcgtgaataatcaaactgaagaggcatgtggagtccagagaactggggaatcatctgagaggacagaaagaacatgggccctggagtaagacaggcctgaaataaaatctcagttctgtgacttactagctcctggatcctaatcaagttcttttaacctcaatgaactttaatcaccttgcctgcaaaatggtgaaaatgtcacttaagtactgtaaaaattaaataagacaactgcatataaaatgcttggcctatggaattcattcaagaaatattattagttccttccacctttgtctttttcattgttaaagaggtgttttctgaaaacataccgattgaagttaatgtctgggtaactagaatactccgatttcatctgagcatttcatcgtggaaatgtgcagaagaaagcattagctaaaagactggcaatctgttcctgcgacattgtgatggaatgattcatcttctgtttcaggagtggtattggctgataaaagaaacaaaaaaatacagacgagaagagcaataattagtttagcaatttcaaaagcagaggcaccaaattgcatttgctaaattaaggcagaaataatttcaggccattcttgaatccttaaatcagcaatattgtaaaagtcaagggctgtttatcagggatgattcagaaaatgcacttatttgacaaactgcagatttctaatcaataataatgatagtgaagagaatataaaacattacttattagtgaaaaacaagattgcttcagcaagtaaataaaaacacattgcccatgtaatgaaaaattagaacaaaagatgaaacaaaaatatataacattgtttaagctaaattttgttcttatttatattaaaaattattggctagaataatctttcttagtcctcaataaaatgatctaagataattcaacaaataagtcttaaccctccctcttattccaaattacacttcatactcacaatttctttataagaatcaaatctaacttcattaaagctattaatagaacatgtaaaaaccaccatacggacatgtataagttgtaaaaagataagacatttcttacataaccaaacattccaagtcatggaagatgtaagacatttttccttcaaatcttttatgtctaaaatgtcttctagttatgccaccaaattcacttaccttttatttcagtataatccacacgacctgagtattgtgttcagtgggttttattctgtttgtaaaccaaaaataaagttccaagccccccaaccaactgaatgaacccctcctctcgaccaaggggattccaaagttaacctgaaacactagtccacaccatgataggaagtgtgggtctgacacgcctcattatatgctcctcactttagaattcagcacaagtgaccagcattaacaagaaaacagagaccttaaaactgatgaaacaaatctttttataataataagactcaactccagcctgactcgagtatagcatcacatgacagatagcataccttgaaagaattgaagtattttaccccaaaatatatttctttgacatattttgaaatagccctgcaaagctgtctgttgggaaaatgtacgttctgtaaagaatctctattcctttccaggtgagaattaagaaagggtgtggtacctttttagatctgataaaagctctgaagcctgttacaaggtttcatccacatgataaaaccttggtctccacaaacccttatcttaacccagatattcctttctattgattccaggtctttgactcttccaaccaattgccaatcagaaaatctttgaatctacctaagacctgtaagccccccttacatgtattgattgatgtcttatgtctccctaaaatgtataaagccaagcctgaccatcttgggcacatgttctcagatctcctggggctgtgttacaggccactggttactcccatttggctcaaaataaatctcttcaaatattttacagagtttgactctttttgttaacatattttaaatgttaaactatgtttttaaagacatgctgataaaatcaaagaccaactaccagtttatccttctgctgttaagtttcaaaatgctcccacagaatatttagagatgcatttcattctccccttcagtaagacccagaactaagagtttcgggtaactgcactcatctcaaaatggcatgcctagagcaaactgtcctgatcatacctcaggagtggacacccagaatgaacctgaggaaagggcaggcaagacaaaccaaaactgcggtgctgaataatgaatgcttttctaagtacagaagtacacaccactgctagaataagagtttgccagaaaaaagaacagattaaacttgtaattcaactatttctcttggaaaaattcaaaggtaaacaaataagcaaaaggtaaagaatgtattttcactatgtttacaaaattctctccccttcaggtcttagcaatcaccatttctgagaaaaatagagagctcatattgatctccattttccatcctgtgcatttgttcacaaccaagcaacgagtttagaaaaggtgacagtgcatcaatggcttcaagcaaagtgctgcttggttttaggaagaaatgagtttttaactaccatttaccaagttattcagaaaaatgattttaaaaattaatggtaaatatttcaggcttaatggacttcaaacacaaacatttcttgtctcccaaataaacaaatagtataattttaaatagagttaatgatttctcctctcttggtgaggagaaatgcctaaaaactcattatttggagaaatcaggagatgtaaatcttactgtcaagcaatcggctcaacaaaataagaggctggttactgtgaaccaagatatttcaaaaagttcctgaccaaatttgtttcctttaattttattttgataaatctaaaatttaccctttagatttggcctagagtacttcaatgtgataaattattaaacaccaacatatacaatttaacttgccacaagacgtattttgatctcaaataaaaatcttaactttcacagcagagattgacttttcaatagggggcaaagcacagaatttccatgcctacccgttgatatgctaatggagaagaaagtcactgagagaagccaggacaaaaagctgaggactcaggggtctgattttggttccaagggacttgttatagcttacaaagtcagatacctttgaacaaaaatttctcattaaataaaatatggaaactctcatatgcacgaggggaagaggattaaatggcccacacccaaaggctacctactacctattattgattatgaactacatattgaattcaaaaagcatataattaagcaccatgcaaaccagggacacaaagaggatctccctttaaggagactataatccagtggcaagagatatataatgacaagaattacaaaacaatgatttgagtgcttcaagagggatgaaccttgcctgggaggcagggaaggcttcacaggggaagtaacagacaggcatacctaggaggtagggagagaatttactaagtaaggagagaaaggaaaaagaacaaacatggaatatgatcaagcaaataacttccaacagaaacaagaagatatgttttaaaatatatttcccctgcccaatagtaaaacttatttcaggcacaatgcattactgaggtgaaattaaagttacataaaattgaaaacatcacactggaaaacatttcatgggtctcaactgaaggtggcatagtccaggaaggcatttggacatgtatgggttgttttctggttgccccagtgaccctatttgtggtttttggggtgtcctaatgacatattgcaatgcatgggaccattatacacattcagaaattgttccacccaaatgtccatagggcccctgtggagtaaaatgctagcagaaccctggctagcagccatgcagcaagaggcgttggccctagaaataaaagacaaaggcaaattcaagcacggttgtgagaaacacaggaataaaattatgaacaaaacaaaccctgtggaggtttgaaaatacgttcacaaattctttgatgctcctctctttaagaggtggagtcttgggcacggtggctcatgcctgtaatttcagcaccatgggaggcaaaggcgggcggatcacatgaggtcaggagttcgagaccagcctggccaaaatggtgaaactccgtctctgctaaaaatacaaaaaaattagccgagtgtagtggcacatgcctgtagtctcggctactcaggaggctgaggcaggaaaatcacttgaacccaggaggcagaggttgcagtgagccaagatcatgccactgcattccagcctgggggacaaggatgaaattcagtctcaaaaaaaaaaaaaaaaaaaaaaaacaggtggtctaatacccctccccctgggtactggctagcttccaatgaacagaaaaacagcagaagtgatgctaggtaccttgagaaaaataggtcatagaagacactgcagcttccttgctctctcccttggattgcttgctctggggaagttagctattatgtcataaggacaatcaatcagcctatagagagacccatgtcagggcgttctgccaacagctctgtaagtaagccaacttagaggtgtgtccttcagccccaggcaagccttcagatgactgaaaccctggctgacatcctcaccgcaaccacgagagaaatcctgatccacaaccactcagtcagctaatctgctcccaaagtcaacagaagctgtgagataatacatgtttattgttttaagccattaattttgacataatttgttatgtagcaatatataattaatgtactccaaacaaaataaaatacaggattctttatttttaaaagttaaggctggcacagtggctcacacctgtaatcccagcactttgggaggccaaggcatcatctgaggtcaggagtttgagacgagcctggcaaacatgctgaatcctcgtctctactaaaagtacaaaaagtagccaggtgtggtggcgcacgcctgtaatcccagctacttgggaagttgaggcacaagaattgcttgaacccaggaggcagaggttgcagggagctgggatttgtgccattgcactccaaaaaaagaaacttagccgggtatggtggtacatgcctataatcccagctacttgggtggctgaggcaggagaattgcttgaatccaggaggtggaggatgcagtgagccaagattatgccactgcactccagcctgggtgacagagcaagactctgtctcaaaaaaagttaagaaagtatcattaactcatttgttgtagaatttgggggagggtgaggaaggagtgggtcgtattaagccattttgaaaatacgctattccaaatccactagtatgttttgaaataatgaatacttttttaagttagaggttatttaaacaaagagagaaaaaagtcaaagtaaacaagcttcaacagtgtaaacagaagctgaggaatggaatgctgcatttttaatgtccttttgtagtactctctaccctctaaccttttccttaatacagcaaaattactatactctttggcaaaaactgtttcccatttcttctcttctcttctcttcctctctctctctctctctctctgtctctctgtctctctctctctctctgtgaccctggccattcaagtttaagggaaattcaattgtcagtctcagggaagctactgaggaagctacatccactaacctgggtgcaaatatttggcagacagagtgcaattttcaccatatcaggcaagatggactgatataaatgttgagcttctgtttcttcaagtacctgaaaaccaataaaataagttatgtgaataacaataaccagtaaatataataaccaatgaatatgtttgttatgaaattaaattacatatctgcttttcatggaaccccataaagtggcaccctatcagcatcaccaaacacatgtacaaatgcatcaacaggtgtatacaaataaacttacaaattcatttccaaatgtatatttggcattaaggcaattcaccttaatgccctctgaaaaaaatgtaagtatcccaaatatcaaatatccctcacacaacattcacaataaagtaaaaacacttgcaaatggaaaacagtacattctgcccttggttatatcaactagaaactgctagacaccagggactttcttagaagcccccaaggacccatctagtttcaatggtctacaattgaagaaatctccataaaagccacattaattacttcagagcatactctatgggtcaaatctaatctgttgggtaataaacaatgaggtttctgatggtcttagaatttctcttttccagacacccttggaaagtgaaaaccacaattcccatataaaaatttgaagcacaacaaagatgccatgcatggtccatttttgtcttttataaaatttcccctctctataacaccttttaatctaatgtctttctaaacatcagggtatttctttaaaagtactggaaatgacaacactcttaatttagagatactacatatacagtcaggactgaagtaaatactttatctacttgaaatcacattttaactagaagaggcctcagttataatctagtctgagcttgtcactattacagagaaaactgaggccaaggaggttacctgatcatcctacattgaggtcaattaaaaccaaatcagaacaagaacctaagtgttctggtctctatgccacagctcttcctacttccctatgtgaccaatgtttggaatcgatgaagaaacagactcttgacaaaaatcaggaactaagctgaaataaaggtaaaaccatttgtttatctgcagccggacagggtatgtgtgtaaatagaaaaagtaacaaagaatatttgccctgattttgccagaaaattctaacactaagaattttctttacaccaaaactctaaaacccaacctatgtttacttctcttttaaaattaagataatgagtaaacacattcagaatgaacagaaggatatttgtaattcagagagttggaaattcaattagtcataagcatacagaaaattaaacaaaagacaattattaattctggagaaaaagagttgtttaagagaggaaaagcaatcacagcccatatatgaatagtgtttatactatccaactgaaaaaagactactgatgtaattgaaatgaatatgaaaactatagtgagaaaatgcagaggtagaaatgaggtttgcatttatggtagtggagaaagtgagaataagagctaaatcctaatcttctaaagtgggacttgttttaaaaagactttagagtagtcaaatgactgcctctttataatctgcctctttaactctgttaaaaattaaaaaactaaatttttaaaaaatcatatattcatagatgacattctactattttagaggtatgcactaaagatactggcttctctatacctgaaaatatataaaatatattaatgcatttgtttaaaatattcaaactcttcctgtttataatttatctttttttttttttaatagaaacagggtcttgctctgttgcccaggctggagtgctgtggcatgaccatagctcactgtaaccttgaactcctgggctcaaaaaatctcttcctgcctcagcctcccgagcagctaggactatacaggcctttttgctttttaaaactatgtattctgaaataattatagatttacaggatgttacaaaaatactacagaggtacagtatacctctcacccagtttctctcaatggttacatttcacattactataacatactaaaaaccaggaatacctgtacaatgtgtatcattctatgccattttatcacacatacatttctgtaatcgccaccaaaatcaagatgcagaaccattccactgcaataaagatctcatgctacccatttatagtcacactcagcttccttcctctcgctattcctaacacctaacacccactaatttgtttttcagctgaaaaattttgccatgttacctacatggaaacatacaagtcttttgaaattgacattttttacatggcttaatgcccttaaaaggcattcaagttattgcaagtatcaatagttcactcctcctcattactaagtagaattccatggtatgaatataatattatataatattccatggtttgtttagcaatttcacctactgagaggcactttggttgttttcagttttgtactattataaataaagctatctttagtctcaacctatctatattgttgtctgaaatcacttcctataaacagcacagtgtgtcatttttaaaattcactctgcacatctgtcttttaacagatgaatttaggtcatttatgtttaatgtagtctttgatatgttgaaacttaaatctgttatttcattttatttcttttatctgttttcttttcccttcctccttatgggttacttgaacatagtttaaaattccatttttgtttatctaaaatgtttctgactgcatctctttgaatagattttttttaaagtagctgctgaaggactgcattacatataacttaccaacatttactggtgtcaacatttcaccagttccagtaaagtgtagactttaccttcctttaaattcctttacccttctccatttataatcttcaatatttcctctacatacattgataactatactattttacaatatttgaaaacagtgaaaaaagtcaaacataatttacaacactcaaaaaagtttttaaaaagtctattatatttactatatttttactctttgttgttctttcttctttcctgatgttccatgattccttttttttataatttcttttctgtttcaggaaatttctttagacattactttatgttaggtccactgatgtcaagttctgttttccttcacctgagaacactgtggtttcctcttcctttctgaagaatatcttaattggatatggaattctgggttgacaattctttccttagtcctcaaaattttgtgtcacttctttctggtctccatgtttgctgctgagagatccgttgtcattcaaactgtttttctgtataggcattgtgtcatttctctcttgctgctttcaagattttttctttgcctttggttttaagaaatgtaattatagtatgtcttggtatgaatttctttgggtttatcctacttaagttttggtcagcttcttgaatctgtagatttatgacttttgtcaaattttggaagttctcagccattatttctttgaatattttttcagtcccaccctctttcccctccctttctgaccacacaaagacacaaatgttatatctaaactctgggttttgttttttcatctattttctcactgctgttcagactgagtaatttctcttaatttcttccaagttcactgattctttcctctatcatccccattctccattaaacctgtctattccattttaaaaattcagttattatatttttcagttctaaaatttccatttggtttctctggatagtttctttttctttgctgggactttctgtttttttcatttgtttcaagtatgtttataattgctcagccttcttgtgatggctactttaaaataattgtcagacaattcacatctgtattctcctggtgtctattgatgttcatttttcatttcagttgagattttcctgattcttttctggtcatgagggacattttgttgaaatttggatatttggggtattataaatctttagatcttatttaaatcttcagccagagcaggccttctgtgatactgtgccagcaggggaatgggatagctacttcattaccagcaattgagggtaaaaattcatgttccccagtcagcctttagtacccaaagtggaaagtgagagaggtacctcgatagtgctgggttggggtgagagttccagctccccactaggtctttactgataccactttggtgccatgtactctcctagggtcccatagtccctgctggtcagtggtcttctacctttcagagtcttatgtttgttttacatacaaggtcccctgtttttcactgtaattagtgggaaggacagacagaagtgcctattcaaccatgttaaacctaaagacatgaaaccttaagtgtcttaacaagctgacacgtctcctttgggtatccatctttgtcttttaaaactgacatgagtggctgctgcagtgctctgctgacaagctttacaatattgcttatttatctgatgaagcattattgcactgtacttcttcacaactgtcaacactccagacctatgtctaatgctgctttggaaacacaaaaagggaacctaaaaatgtcatttaagaacataagcgactcaactactgtttgagatggaatgcataatctaaaatatcaccatgaccttataacctgtacaatgcaaactgggatgcaagtagggaaaagttatttaagatgtacatcatttcttaacttcaagaaaagcaagagccattggtcaaatcttctataacaattaaagaaaaataaacatacattacttattatgatgataatgatgattataagggaggtaagcatttacatgatggtaaaaaaagaaagttgtattaaattctcccacaagtaaaaccctgccctctactggatagtctgcatagataattacatacagcaagtgttttgatctgtgcgtgtgcgcgtgtgtgtgtagcaactttttattctagtcccacaaattggctgtatatatatgtaatatatattatacatatatttcagtcaaaattgatacaataaatttcaaaattatactgctattttgcctatctcctttccttagattatagatatgttcattcattcgattggctgataaacaaatacctgaggaactattatgtctcaggaattgtgccagaagatgacagaagagtaaacagttaacagacgtggtcactgacctcatgaatctcatggcacaaagccctatcctctccctgtgacccccaatacatcagccctaacctaggagggcagtaataactgcaaccacatcatagtgactgtggacaggctatttttttttcttctctccacaaatagaaacaagctactaaaataaaggaactaaatctgccaaacatcaaaacgttataaatatttaaatatctacaaacatccaaacagaaaagagatatttacttatttcttctttctttgaatatctgattaactacatacatctgttaaatgtgctctaatatttatgaaagacatatttatacatgactaagtaccatacctgacatatggaaagtattaaatattgactactgaactttgaattaataagtgaaatctgtagctcgcaaaatgagaagaccagtgttatttcaataaaagaaaatatttccatagatctttttcaaacagtttagggcaaacagctttaaaaaagtaatcaggccgggcgtggtggctcatgcctgtaatcccagcactttgggaggccaaggcaggcaaatcaccaggtcagcagatcaagaccatcctgtctaacatagtgaaaccctatctttactaaaaatacaaaaaattagccaggcatggtggcacatgcctgtggtcccagttactcgggaggctgaagcaggagaatcgcctgaacctgggaggcagaggttgcagtgagccgagatcgtgccactgcacttccgcctgggcgacagagtgagactttgtctcaaaaataaataaataaataaataaataaaaaataaaaaaaaatcacaaattaatgaatataagaaatagcacaagctgctccgttttctctattggtctaaacctagttagatcctaaaaaaattgtgaaaagttactaacaatcctctttaataaaaaaaaaatgaaatctatatgaaacgtctaggatgtgaaattttagacaatttttcaataagaagtacaccactccaaaagctaaatagcaaagaggatatatcctcataatcctatggtccatatatatatatatatatatatatatatatatatatatatatatatttttttttttttttttttttttttttttgagatagatctcactctgtcacccaggctggagtgcagtggcatgatctcaggtcactgcaacctccacctcccagattcaagcgattctcctgcctcagcctcctgagtagctgagactacaggcacgcatcaccacacctaggtaatttttgtatttttagagatggggttgcgccatgttggccaggctggtctcaaactcctaacctcaggtgatccacctacctcagcctcccaaagtgctgggatgacaggcatgagcctgtaatactgaagatgagtgatggaaacagggaggttcattaccccattttatttttgtgtatgtctgaaatgcttctttaaaaaaaaatttcctggccgggcgtggtggctcacacctgcaatcccagcactttgggaggctgaggtgggtggatcaactatgttcctaatagtaacataaccaatatttatacctaagtttctttttccttttacataggtgcatttatcagtggaaattatgttgctcaatttagtattttttctcaccaaatatgacaaaaaggcattttttacatcactaaaggcaaaatgttttttaaaatgtcatgtattttcactgaagaaaattaatataaacaaaaagaaaagaaatattacccacaagcccactgccaagatatcctcttctcagatataaacagatgcgtatttcctccccaaacttcttctgagaacttaggtgtgtgtgcatataaacacacagttttgtgttaccttaatttttaaaatattatatttttctacaacttgtttttgccttaagagaaagcctaaaaagtctttccgtattatacaatgacaaatgctacacagtattccaaagtagagaagtacaataatttttgtaatcattcccctttgagaaccatttttcccaacgtttttaaaaatttcaaaaatatggtgaagttaaaataactatacactgaatacccaaatactatttggtttctatgattaacattttatatttgcttttgtcatgttgtcatcagtccattcttctgaccacatatcaatgcattttttaatgcgttttgaggtaagttgcaagcattccaccccatcacttcagtttgcatatcagcaactagagttcacgccaggcatggtggctcacccctgtgatcccagcactttaggaggccaagccaagtggatcacttgaggtcaggagttcaagaccagcctgggcaagatgatgaaaccccatctctactaaaaatacaaaaattattttattgtatgaatacacccacaatttgtttattcattctcttgttgatagatacctgggctgtccccaggttttggctattataagtaaaactgctataaacattcttctacaaatctttttgtgtgcatatattttcatatctcataggtaggtatagaaagaaatgaaattaatgggtaatagggtaagtatatgttcagttttctaaaaaacagccagacctttttccaacattgtagtacattttaaactcccaacaacaaagtatgagagttgcaactgctccatatcgctacctacatttgatcttttagtctttctagtgcctgcaggctaatatcttttctagttataactggcatttctccagtgacaaataatatcaagcattttttaatgtgcttattggcaatttgtataccttcctttgtgaaatcctttcaaactcttgctcattttctagtgaggttggctgtctttttatttttcaattgtagttctttatatattctggatacatgtcccttgtcagataaacattttgcaaatatttctccgtcttttaaaatttatttatttctatttatttatgtgagacagggtctcactgtgtcgccaaagctggagtgtcatgatgcaatcacatctcactgcagtcttgacctcccaggcatcaatcctgtcaccctcagcctcccaagtagctgggactataggtgtgtgccaacatgcctggctaatttttgactttttttttttcctttttttttgagatggagtctccctgtgtcgcccaggatggggtgcagtggcgcgatcttggctcactgcaagctccgcctcccaggttcacgccattctcctgcctcaggctcccgagtagctgtgactacaggcacccgccaccacgcccagctaatgttttttttgtatttttagtaaagacggggtttcacagtgttagccaggatggtcttgatctcctgacctcgtgatccacccgccttggcctcccagagtgctgggattacaggtgtgagccaccatgcctggcctaatttttggatttttaatagagaccattgccatgttgtccagactggtattgaactcctgggctcaagcaatgcatctacctcagcctcccaagctgctgagattacaggtgtgagccaccacacctggcctccaagtgatccttccacctcagcctcccaaggagctgggaccacaggcatgtgccaccatgcccagctaattaatttttttttttttttttttttttgtagagacaaggtctccctatgttgcccaggctggccttgaactcctgtactccagcgatccctctgccttggcctcccaaagtgctgggataacaggcatgagccaatgcgcctggcatccctgtctttagcttgcctattttcctaatgtgttttcgtcacaagtatttataagtttttttcttttatagctaaggtttcccattagctataaaagctgtaggtcctaggaaatctttgtcgactcctaagctacaaagatgttttcctctagaagctttatagtttttgctttttcagttagaatttagaattattttctatgtatagtatgtgggaaggggcaatttttttttttaagcccacatggaaatccagtttcgccaacaccatttgttgaaaagacacttcttttcccttgttgtattgctttggcacttttgttgaaaaccaaatgactgtataaacatgggtctgtttctgggtttaccacttggttccactgatcaatttgattgttatgtcagtatcatattgtattcatttccttgagctgctgtgacaaagaaccacaaaccaggcggcttaaaacaacaaaaatgtattatctcacagttctggagtctagaaatctggaaccagttgttggtagtatcacgctccctatgaaggctctaaggctcttcctggcctcttcctagcttctggtggcttctagcaatccttggggttccttggcatgcagatacatcagtccaatctctaactccatcatcatataagcgttttccctcagtgtctttgtctctgtgtcctttccttctctcataaggacaccagtcattgatttaggatacaccataatccagtgtggcctcatcttaactagttacatctgcaaagactgtatttccagataaagccacatcctgagagtccaggtgaacattaatttggggggacattattcaactcaccacacatactgtcttgtttactgtagtcttattgtaagtatccaaagcaattcacgtaagtctgcaaactctgcccttcttatttacaatttctttgtaaataagggtcctttgtgtttccatataaattttagtaatcagctttgcattttctacaaaatgcctgcttggtattatgattggaactgcatatagggagaactgatatctttttatttttttgagatggagtttcactcttgttgcccaggctggattgcaacggcatgatctcggctcgctgcaacctccgcctcctgggttcgagcaattctcctgcctcagcctcctgactagctgggattataggcacccaccaccacacctggctaatttttttgtacttttagtagagatggggtttcaccatgttagccaggctggtcttgaactcctgtcctcaagtgatccacccacctcagcctcccaaagtgctcgattacaagtgtgagccaccgcgcccggctgagaactgatatcttaaccacactgagtcatccggtccatgagcatggtagatattcttttattcaggttttcttcaatttctcccagcaatgttttacagtcttcaagatactggtcttacacattttttgttaaatttatttctaagtattttatggttttttaacactatttttaatgaaatttttaaaatttcatttatggtaagtatataaaaatataatgatttttgtatactgaccttatgtcttgctaaataaattagttctaatagttattttttaggtttcttgggtttttctgcataaacaaacactgtcaactacaaatagaaacagttttacttcttcctttctgattttcaaacattttatttctttttcttgccttactgcattggctaggatttctagtacaatgttaataagaatgaagagcatggctgttcttgcttttcccccaatctttgggaagagtatttcatatttcaccatgaagcatgattttagtagtaggtttttcacagatacgctttatcagattgaggacatagttgttaatagttttgttgttgttgttttgtttttgttttttttttctggagacagtcttgctttgtcacctaggctggagtgcagtggtgcgatcttggctcactgcaacctctgcttcctggattcaagcaattctcctgcctcagcctcccgagtagctgagactacaggtgcatgctaccatgcccagctaatttttgtaattttagtagagatggagttctactatgttggccaggctggccttgaactcctaacctcaggtgatccacccgccttggcctcccagagtgttaggattacaggcatgagccatcactcccggcctgctaacagtttttcactctgaatggttactaaattttgtcaggtgcttattctgcatttatcacaataatcatacagcttttaaaatataaatccaatcctgcatttctgagatgaactctgcttagtaatcatgtattatcctttttacatatttctagatttcatttgctaatattttataaaatctttgtcacatactagtatgagaggtatatatatatggctttataaatgagttggaaagtgctccctcctcctctcttatttgagtttctgtgaacttagtattatatcttccttaaatgtttcggagaactgatcagtgaaaacatcttggtccacatagtaaccaatgtttaattaggcatattttactaggtattaatcctttgtctcatatatgttaaaatagtctcccctgtctgtcatgaaaccactagttttattatttttattttttaatatctagaatatagcatacttgagcccctttttcagttttatctttatcctttctgttgcttgtttgctactgtccagtgatacttaaccatttgcacctccctaatgtaccatactgacttcattaaatactatgatcaaatcacaaccttttgaacctattttcttacttataaaatgaaaatatcttgcagagatgtggtcagaattataagcttttcaacaaataacagctagtattatgatgatgatgatgcattattttaccctctgccttgtttaacattttactaccattaaaccacgaattatgcttcaggactcagttcccatctccctgggaagccttcgctgattgcctgactgccccttactctatgactctagagccaaatgtacatacttgtattagaacacttactgcggttattacaattatttatctgcatttcctgtcctctgatctgtgaaacacacaaatttaaacatcttgtggccccccagtactaagcatagtatttagtgctcattatttgctgaataaagagttgataaaaccaaaaacattgcattttatcttcaaagtatccttgcaagatagaaaggataagggcatctagagagactaaagctccaagaaataagcaatttgtccacattcaaaaacccagtggtggttgggggcagtggctcacacctataaccccagtattttgggaggccaaagcaggtggatcacttgaggtcaagagttcaagaccagcctggccatctctactaaaaatacaaaaattagctgagcattgtggcccacacctgtagtcccagctatttgggtggctaaggcatgagaatcgcttgagttcgggaggtggaggttgcagtgagctgagatcatgccactgcacctccggcctgggtgacagagcaagactctgtctcaaaaaaaacaaaaaaaaaaaacaaaaagacattgggactagatgccagagtttttcttcccaggttcacaaggaaggatataaaagaaatactggccaagaaactggaagactagttataggcctagatcggcatttactctcatattaaccacagaaaaatccctaaattctttatttcctcatccatagtaaggataattctactataactttaacttacagagttacgaaagctttcagatataatagggttttatgaattctaaagctccatataaaaagtattaatgtctaatgggccagtaattcacaaactttctggagcctccttcttctttgatcacccccatatcaattaactgccaagtcctatattgattgatccagcaggatctcacatatttattacctcatcttaatcactactaaactaccctcagccctcatccagtctcatcaagattactacaataatctaactgctgccctgctgatagcccaccttcagtttctgcccaagtagactatgatgtgcttctgctccacttcaaagctttcaatggctttctgctgccttttcaatacagaacaaatcccttgaactaacagtcaagctcccttaccctagattcttatctagtctcattcagcacatatatataacatacacacactcacaaactctaccttctgtgcagcctacatactagaaactcagaaattcatttttctatagcatctgtttgtgctgctacagatacgatcctggaatatctttccttcttaactccaaaacttatccaaccttttgatcttgctcaaacaatagtttgcttcaagtctatccaaatttactctccagctaaaaagtaattctccctcttgtaatttatttgaactttttttcacaagacacttaagactttctgctttctgttgttatttatgaacgtgccttctagcccttactagaagctcctttaagacaagatttatgattgattcaccattcctacaacagtggtgttcatatgtaaaactgtcaataaaaatatgttaaattaactgacactttctatctggattagctgattttacaaagctcatcctcctcctctccattgcctttcagaatctctattacttagcaaaaatattatagttttgtgtaagttgattaaactgtctataggctaagctttctatactggaactacctctaagttttcccaactctaaagcacaagctcacatttcaaaaattaaaagtacaaaaacattaaatgttagaggaaaaacaatcatactactaaattatgtaagggtaaaaaaatcaactggagaaggtgaaagtttctaacatttatctgtgcacaactcaggctgacactttgaagagaagaatgtgacagcttacaagaaaacaaactcactcattccccttaatttctgaaggctcatgaaagtctgacaggccagccacagggtgatctctcatgtgtatcgcccatgacaattatggcttcaataaaaatggtctctatttttaataaactccaactggttttcaggaaatagccaggctaacatggtcatatttaagaaggcatatttcaccaattagcagctaacttatttagttcatggacctaaataagactgtgcatggagaggtacaaaatcagtgtggtagcagagggcaaggtggtgtgaaaggctgagtccaggggtcagctgtggtgacacatacaaatggctgtgctgaggatcaccttgcccctctactttcttttggtttgatttggttttcctctttaaacagctattaagagtctccctatgaattttcaaagtgtttatgactcaaatctgggaaatactgataaaaatcacagctcattataagcatttgaaatgatttgccctaacgatagataaatgaaatataacgagtttttaaagtactctgtaattcacactggaaataacctgcagttgtccttatattaatttgacagttgcttaatatgaaataatcgggctgctatacagacactttgtttcctccccatcaaggattgccagcagaagggggaaaagaggaaaagaagtgctaagcaatgaaacctcctttcatttttagtctccactcctatggcccagctcttatcagctagtgcaggacgaaggaggaggaatgaagggagaaagagtcctcctgccaattctcaccacaaccctacttccaatctctcctaagcactgctgtgtttctagtgacagaaatctgcattagtttttcacttcagaaaacaagccatcagaggtttaaaattcacagactttctggatgtggtggaaatttccccatcatgactcctaattccaaataattaacaactagtctgggaacacaatcagtttaggaagaagatcttcatccaattcttgaaacaaaatatgcctctaatcaaaaacagtcacactattttcctacacaaacttcattaaacatgaagaatagaattgtgtaggtttataaaacatgaaggaagttcttctttaaacagtatttattgcacaatcatatcgattttcatgctaataataaacagcagaattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaattcatctctggtgtttctgttatctctcacagtgagaaataaagaataaataagaagaaaataatttttttaaaacaaatatcacaaaggattaatattcttaatatatagtctctataaaatttagtatgaaaaaaggaatctaaaaggaaatgcatgaattataaaaaaagagaacttctagattcagctccaatacataaaaggcctggaaatcatctctcccatccttacaacaagaaaaagctagaacactgaaaatcaaccagtgttccaggacctgttggagactcaagggctcagggcaaacctccacctggaaacctggagagttcagcagtctggagtcctagttgggctcagctcacctcgagcagaagccactagaaccacagactggtgggaacacttaggtggtattttgaggaattgctgggaactgagtgtggagtagaacaaaaatgagaaactctagagggctgcagtcttagaggggtcctcattttcatgggccttaagtctaggagccccacaaggtggccatggtgaagatctgagaaagatccccttgtacatcttgcagaggacagggaagtgactttctaccaaaaatacaggatggcaaaggatttttttaaaagagtaactttacagtggagaaacctggcaaacactacttgggccaggtggtcaaggtcactgtcaacagtgataagtcatgtggatagcatgttccctcgatatggtgtgatgataatggcactttactgttgtgggcttcctcccaagaacccagaccctagcacaatcatgagaaaaacatcggacataccccaactgtgggacattctacagaattcctgatcagcactccttaaaactgtcaaggtcatcaaaaataaggaaaacctaagaaacctttacagtcaagagggcctaaagagacatgaagacaaaatgtcatgtggtatcctggataggatgggaacttggaacagaaaagggacgttaagtgaaaattaaggaaatctgaatcaagtatagacttgagttaatggtaatgaatcactgctggttcattagttgtagaaaatgtgccacactaatgtaagttgttaacaataggaaaaacagggtgtagagtacatgggaacttggtaccagcttcacaataattctataaatctagaactgttataaaattaaacgtttatttttaaagtaagaaaaacatgcagtatctgaataatcaaataaatataaattaaaagtaagaggtgtaactttttttcatcaacacattcatcaaaacttgaagttcaatagtaatcaatcctggcttaggtacaataaaacatactttcctggattgctgtcagttagtataatgatttagaaagcaagctttgcaatacagttcaaaaacacactaactcagtaactctatttgtaagcatctattttaataaaataatcagaaagcagataaatgattacgtataaaattttgcatatttgcctcattaaaaattgtaaaaataagtaaaactgaaaaactaggaaaaagacatcatagcaattggtatgggagatactgccccactgggaatcatataaaagccaggctgaacacagaaaacaactgtttcctgagtttgggcagcagacaccccctggtgtggtctctgaaagaagagctcacccgagtgggtaccacctccagattggctttccccaaggatgcccttcaaagtgtaacccatggagatagagccagggagagacagtctgcttgatcaccatgcagggctcaaaattgttcaatatttgaaaatctgtcaaggaaatattttcaattagcaagttaaagaagaaaattcataggatcatttttaaagacgtgggaaatgcatttgaaaaaaatcaaaacccatttataataataactttgagctgaacaagaatggaagagaaattctttagggatgggtatatgctgaagacgctatcaaataatgcactgaaaggtgaatggttgctgtattaccactaaaggaagaaggaaggaaaagaatgtctctccccatcaccaccattaaatactcaacatatattgaaatgttcgtcaaggcaataacaccagaaatgtttacaagagatatgatattggagcaaaagatctaacgctgacaacattagcagataataccattacctaggaagtccaagggatttgtctttaaaacatactataaccaataagacgttcagtaacatctccagtaacacctgtgtgaataaaattatgacttcaattaaaaaaggaaacccaaataaatagatgtgctgtgtttctaaaggaaagacttgatattgtgaagatatacattctcccataattaacctatacatttttgagccattccaataaaaatccaaacttactatctacaaaatatgagaagctaacccaaatttcacctgagtgtgtaaaccagccagggttacagcaaattctagagcaggggagtgagtcaacaatggggcaccagatcactagatatcaaaagataaaccacaagaatcaaaacagaacagaattagccaaggaaaagacaaatcagtgaaatagaatacacagcccagaaaaaaaatattttaattcaatgactaaggaataatgaaatagctggcataggcataattgggatccacctgtgtgtcagatcaaggatggctccagagtctagatatgcctgccatcaagaggtggggtctctgcctcctccctttgaatctgggctggattttagttgctttagagtatgttggaagtgatactgtgccagctccagtccaagtctttaaggcaacagcagattctgtttcctttctctggtagccctgtgctgtcctgtgggaagtctgattgtcctgagttggccatgctgtgaggaagcccaggcttgccattggtggggggccatggggagggagaaaggggaagttgaggggccagcccatgactccttcctcctccatcccagctgagtgccccaacattgtggaccaaaagcaagtcattgctgctgtgccctgtcccaattcttaatccacagaatcatgtgaagtaatggttgtaaattattggcttgagggtaaaccaaattaggggatagtttgtcatgcagtaatagctaaccagaacaacttaggggaaaaataagttagactctctttctacactataaataagttccaaagggatttaaatatataacttacaaagcaataaagtactagaataaaactaagaagactgatagtttaccttgctaggaggtgtagaaaaggcaatttcatacattgttagtggtagtgtgaattgctacaactttttggagagtgatacacaatatctattaaaattatcaattctgagaatctagctatggaaaccaagttcaagttcttatcaatatataagactctctgtaagaagatgcctatcacagcatagttataaaaaaaacaatgaaacagtttggatggtggaatcaattgcatcctatccacacaatggaatgttatggagctattaaaaacaaaaatgctagatctatgcttatgaacctggagggattttgtcttattcagtttgggctgctataacaaatataccccatagatgggtgttttaaacaacacacacttgtttctcacatttctagaagctggaaagtccaagatcaaggtgctggtagatgtggtgtctggtaagattagacagacaccttctcattgtatcctcgcacggccaagagaaaaatctctctcctcataagggtcctaatcctattcctgatggctcaaccttcatgatctaactacttccccaaagccccacctcctgagaccatcacactggaagtttgaatttcagcatatgaattttggggagatacaaacatttagtccaaaacagatctcaaaaattaatttaaaagtagtttcacactctggaagatgatttggcaagttgttaacaaataaacatgcaattatcatatgacccggaaacttcattcttggattttttttcctgagagaaataaaacttgtgttatcacaaaaacttgtacacaaaggttcataaaagctttattcaaaatagccctaaaatgaaagccaggctagatgtcctttaacaggagaatactaaacaaactgatgaatccatggaatgctactaaacaatgaaaaggaacgaaatattaatacacacagtaaataacctggatgagtcagcaaagaattgtgctgaatgaaaaaagccagtcccaaaagattatatactgtatgctccatctgcacgacattttgaaataacgaagctgtagaaatagagaacagattaatggttgttggggattagagattggaggaaggtggacgaatgtgtgtgtgaggaaggggacaagaagaaggtgaggagtaatgaaaaggcaacaagagggtccctatggtgatgaattgttctgtatcttgactgtgatggtggccacaggagcctacacatgtaatgaagtagtgcagaaatacacgtgtgcgtgcgcgtgcacacacacacacacacacacacaagagtacaagtaaaaccagggataacatcaatggattgcatcactgtcactatcctagatgtaattttctactacagcttcacacaatgttatcctcggaggaaactaggtaaagatacacaagaactctatattatttttcacaacttggaagtgaatctatagttaaccaaataaaaatctaaattaaaaaccttttaaaaatattataacaaaatctataatacagtaaaaaagtagctttcagaggtatttaaatatcatcttcccattttggtaaaacaagacaaaatgaaacttcatatatttgaatatatatttgaatgagcacaaggtgtgatagacagagctcaaactattaacactggttacctatggaagccgggatggaggagaaaagaaatgacattatcaagttatcaagatgacattatcgacatattctatgttgacttttttttgctacattaggatgcatttttataataaaaataaatattggaaagagctaaatgaaaaaacaaaaccataaaagtgatagggaaaataatatattatttttacaagtttagggtggagattccctttccaaggaaggaagattcaacacccagaagccataaaggaaacaactaacagattcatctcataaaaaaataaaaactcccacagatcaaaacacatcataaagaaagtttaaaaacaagtaacgtggaattttctaacaaacgaaagattagtagccaaaaattgtccttacaaatcacaaagagaaaacaatgaaatagaaaaattggtgaagactttggccagaccactaggataaagcaataatgttgactgctaaaacagaaatctttcagccttggtttggcctgagactctgaaagtcaagaacaagacagcaggtgccaactagccccagcgtctacatgctggaccccgatgcaagacctgctcagaggatgatctaaccctccacctcttacccaaaggagaggcagagggagacagggcttcttgtgaagagttggcagtggcccccgaggttccttggagacacacatgggcacacacacgcatgcacactcagacacacacggaggaggaaggcaatctgcttctcagcccatgccagagggcagtcacactgtgagaggaactccaagatgggtcaccaggagaatgtgacatgcgtccctccaaagactgaaggtgagggtacgtggctatgtctgctctgcccaagctggcacaaggggaagcaaaggacagtgaagagaggggaaggacctagggcatctaggccccaaattacaggctgatggtggcactacgagtggccccagtgaaaggccttccctctgtcaagaaaaggacaatctgggtccacagtggattgggccttcatcagcccccaaagcatcattcaaagagagcatcagaaattgcacccagaagtctgaaaaaccccaagctgtatgacatcagccactttgtggccttttttcctaatcctttctccttcctgagtccagcttaagaaggataataagcagttcctgttgagttgggggaaaagaagggtgagaacagctgagtttctctaggcagctcctgctggaggctggggaagctttcactgggatgagagcccagagtcagatttacgctggtcctgactgtgctgtgcggtcctgacagtgctgtgcgatcctagactgaccgactagactgagccactgaaaatttagtgggagttgccccagattttattgaacagcagggaaggaaaaccaggagagcagattggaaagggcaatagtgagaactacagaagcggtcctccacttggcccccggtgaagtcccctggatcctgtccagaaaggtcctcctcaccagcaatcaaaaaaacacaaattaagacaaaaatatgtttctctcgattcagaggggcaaatatgcaacatgccaatgtggtctcaggatggtgaggaaattgctcatgcatcactgaagagcctgggagtgcaaaaactccctccagaaggcaaaatgcagatttgctgaaactaaacttacactttacaaaaatcccacttctaggaatatgttctaaaacatctcttgtatgtgcataaagttgaatatagattcattgcctcattagaaaagtgcaaatttagaacaatctacgtttccatcaataagggtggctaaacaatcatatgaagaaagctctacatcactgatcattacagaaatgcaaatcaaaaccacaatgagataccatctcacaccagtaagaatggctattaaaaacaaaaaagaaaacagatgctggctaggctgtggggaaaaaggaacgcttatacactgttggtgggagtataaattagttcaaccaatgttgaagataatgtgacaattcctcaaagacctaaacaaagaaataccattcaacccagcaatctcattacagggtgtatgcccagagcaatataaataattctgttataaaggcacatgcacatgtatgttcattgcagcactatccacaatagcaaaaacatggaatcaatccaaatggccatcaaatggtagactggataaagaaaatgtggtacgtatataccatggaatactctgaagccataaacaagaaggagatcatgtcctttgcagggacatagatggagctggaggtcattatcctaagcaaactaatgcaggaacagaaaaccaaatactgcatgttctcacttataagtgggaggtaaataatgagaacacatggacacatagaagggaacaacacacactgggcctgtcagagggtcggagggaagagggagaggatcaagaaaaataactaatggatactaggcttaccacaagggtaatgaaatgatctgtacaacaaacccccatgacacatgtttacctatgcaacaaacctgtacattctgcacttgtactcctgaacttaaaagttaaaaacacacacacacacaaacaaaacacgatgactgcatacacacacagaataagatgcagctggtaaaaagaatggctctatcttctgatataaaaaagtctccaagacacaggaagtggcaaaagcaaatcacagaattgtatccaatgtatgacactccttacattaaaaagcaaatataggccggccacagtgacttacgcctgtaatcccagcacttttgggagggcggatcatgaggtcaggagatcaagaccatcctggctaacacggtgaaaccccgtctctactaaaaaatacaaaaaattagcccggcgtggtggcgggcccctgtagtcccagctacttgggaggctgaggcaagagaatggcgtgaaccccggaggtggagcttgaagtgagcgaagatcatgccactgcactccagcctgggtgacagagcaagactccgtctcaaacaaaacaaaaaaaaaagcaaatatatatgtatgcgtgtgtgtatgtatttatatattcatacatatataaatatgtaaaaaataattagagaattctcatcaaaatgttgccagtggttacctctgggaaggtagtggttacctttgggagggtagtgggtacatgtgaggagaggttttttgtttttttgtgttttttggagacagggtctcagtctgtcacccaggctggagtgcagtggtgtgatctcagctcactgcaacctctgcctcctgggttcaagtgattctcgtgcctcagccgcctgagtagctgggattacaggcatgtgccaccatgcccagctcatttttttgtatttttagtagagacagggtttcaccatgttagccaggcaagtcttgaactcccaaccccaaatgatccacctgcctcagtctcccaaagtgctgggaccacaggtgtgagccaccacacccgcctcacgttttttattgagtaaacttcactgctatatgaatcttttgtaatgacaatgtatttatatatgtgtatggtcaatgttaataaaggttagagaagttaaaaatgaagaaagagtactgtggaggatggagtggatgaagggaaaagccaatcagagaagcaccctagggtgctgtagcagtagtccaggggacacctgtgaaggctggaattagacatgggcacgggaggagaagggggagcaggtgagcatgggcttaagaggacaactggcacagtttgttgactgtggacatgcgggctgagaggaagaaaatagattaatgtgatgactaatgtagctgatgacaactgtcccacacttcgagcaggggcccagggcaaggagcagggtggggaaggaagcagaggtgagagttcatatcccaggggatacacttctggcccatcagacagtggagtgtgtgggcacacacctcaggcggcagatcttggagattccaatttgtatttctgaacatgtaagtggctttgagcatgatcaaggtgaacaagaatagaaatatggaaggcaccaacagatgatggacagatgaggaaggagatgataactacagcaaaaaggccaaccacaggagaggctgccatttgttgagcaagtgagatatgctgtgtgctgtccctttattttattcaatcattataataatgggaggtgggttttatcatgattcccattttataaatgagcaattggaagcttagaatcaccaaataattttcccaacatagcaaagaatccagctctggctgactccacactcacagcaactacaccacttcgcttctgccgaagcaatcctacttgcactcctccttttggattgctgagaagcatcactatctaattaccataaagccccctcctctccatgcctgctatctttgtcctggtttgagacctctttatccctcccatccctaccttcagtctatcctgcacaggactgacaaagtcatcttccagaatcacaagcatgactacatcagtattctacttaaaatccttcagtaagtattctctctaccagtcgagatgctcgagcaaggaacagagagatactattgtctgaaacaaccacaaagacaacaaaacacatgaaacaatgggtttcttttttatttgtttttgtttttcagcttatattttagattcaggggtaaggaaggattttacctgaagccttagcgggagcatggaccttgagaccttgagtttggacttccagccttcagaactgagagggaatgcattcctgttgtcttaagccacgcagtttatgattctttgtgacagcagccctaggaaactattacaataggtttatagatttcatcagacttggaaaatatttgaccattagttcttcagttctttttctttctcaccctctcttttgctcctctgaggactcaaatgacctgtaaattaggccactttaaattgtcccacagttcactgatgctctgggagtcttttaaagacttttttttttttttttgagatggagcgtcactcttgtcacccaggctggagtgccgtggtgcaatcgcggctcactgcaacctctgcctcccaggttcaagtgattctcctgcctcagcctcccaagtagctgggattacaagtgcctgccaccacacccagctaatttttgtatttttagtagagatggggatttcaccatgttggccaggctgatcttgaactcctgacctcaagtgatccaccccttcttggcctcccaaagtgttgggattgcaggcctggaccactgcacctggcccaaagactttttaaaattttctttctgtgatttctattgctacgtcttcaagatcaccagtctcttgtgatgcctaatctgatattaactccatcgtgtgtattttaaatcttatatattgtcttttgtttggatcttttaaatatcttccatgtctgtacttaactttttgaacatgtggaatgcagttataataacagttttactgtccatgtttactaattgtaacatccatgtcagttttgcatcagtttcaattgattaactgtctctcattatgggttgcatttttttgcttctttttttattcactgctagacattatgaattttaccttgtttggtgctagctacttttgtaatcctatgcatattcttgagctttttatatgcagttgaattaactgaaaatcgtttgatcccttcaagtcttgctttcaaattttattaggcaggacaagagctgggtttagtgtaggactaatgatagccacactcatgaggcaagaccttttgagtactcaatgcccatgaattgggaagttctccagtctgtctggtggagacaggtgttgttcctggcagcactccattctctgcctttgtcatcacatgatgtttgtgtctcctcttcttgtgtacaagaacaccagtcatatcaaattagggttctccctaatgacctcattttaactggagaaaccttaactgattgctttctgcagccaaccagaggtaccttcaattttccatttgccacagagaaaaggggaaagatttgcaaagggagcagccttgagtccttttgttactgaggcatggaaagttggggttttcctctcaatttagttctaggaagtcagtgtgaattgatcttagattccctgcctccagaccctgttctcctgcctcaataggagagaaaagctacaacaataagtgaatccgcccaggagatccataattgaaaaagttttagaaaagagaacagagaaagtatatggagtgggggtcagtaattaaagaaaacaataaaataaaatgtatcagattttgcataatgatcatcagcctctagtgtgaaaagacccactgaataacccctaagtgaaatgagatccacgccaaccagagcactccccggataaaagagaaaatcccgaaatatttcagagagggatctggccttgtatgaaagaagaggggtgagaacggtgtctgacttctggtggcagctctgtgagccagaagttagtggccatggcttcaaattctaggtcaagaatctccgaccaagctgccaatcaaacatgaaggtagaataactaatttttgcacatacaagctctcaaaacatttcccagtacaaaacattcttcagaaagctatagagagggaaaaaaacaagagaggacccatctttcagcaactagagacccagcgcagggaaggcaaaggggactcccagaaccccaagacaaccgttggaccaccacgtgtgctggggcaggggcctgggaggatgtcgctaggagaggaagcccagccatgatgcatctgcaccactgcaaagagagcccccttctggcccagagtctagggatgagtgggaagacagcactaaaccaagggaaatcttggcaactgtttattccaagtaaaacaaaaagttgtacaaaataggaaatgtgcactgcatggtttagctgtgaataatacgaacatagtcataactatgtaaataccaaatattgatttggccaaaaattaggctgtaactaccatgatggggttgagacaaacagagagacagcacgtatgcacaggaggatggtgtttttaaagagcgacatcctcctcttccatggtggaagttcatcccgtgacatttaaactggaaaatcaagaaatggccttctaaacttgttattttaaagtcaggaggaaagcaccagaagaaacggcaggaattcaaagtgattgcctctggggaacgggaatctggagtgggaagaggaacgctgtttctcattacaaaccttgaagaaccatttaagttttaaaactacatacatatatgactctgataaacatacatttttaaaactacttacaaaacagcaaggaaaagattaagaagggtgaaggcagcacatttcagactgtttcagcgacttacctccaagtgagtaaatacataactcagtctatgccatttaggcatagacctaaaggggtggcatccagaaatttcttcaaagtcttacttattatctttaaaattcaggcagaagtttttactctctttcataatacatccctgtttgtttttatagtatgtggcatacctggcagaaggttttcttttcctctccttttgccttctttctctttcctgagacacacatcaggctgggatgacagagaaagacattctttcagtagaataaggtatagagggtgcccgtaggattaactgggaagggtgaaatatctgataatttttcagtcattacggactagtactaccaaggccccttatagcatctgctcaccccactgtctaagcctggtgtctctgagcagggaactcagggagcttgaagactggacccccagcacaaggccagggtgggaccctcttgggatcaggcggcagacaaagccctggaggaggggaaggagatggagtccaagaaggaaaagacatctcagtcttagcatcagaaagaccatggggttgctcccaaagagttagacctaaagccccacagcagagaaggaatctgggaaggtgggcttcaaggaagaaagtggagaatcccatcccaattctccaactcctcttgtgaattctggaatcagtacagttgttatactcacagcaaacatcgttcagggtcttcttgcacaacagagctttcaaaaatatgctgtgatttcatcagtttcctttattggccactgatatgcaaagtctatcctgaggctcaggatcccccaagttctcccaaagaccctcgggccccagtctaggaagcatggagatgacaagtggaaaacagtggcatcacacatgggacagatgatgtgaagttggcaggaaaattccctgggatacgacttttgtgggggtctctccacgtcctgccctgttggaggctggaagcctctgtgctctctacctcctgggggggcagcagggcagaaaacagaaggttctcagagagtacccctgttcctagctcttgttcttcaaacgtcaggaagtgtgttgggaagaagaaagaagttagctgcagaagccgggagggaaagaggaaagattgtgcagccatcgagggaggcaaagtccatggctcctggaggagagaccctgcctggctagctgtcggtgctgaggaaagcaacttctgaaagcaactgctagagggaggcatggaatttccactcctgtgcaggttgctgtgaccttggggtccagatgcacggtgcccctggccttgaggagaccaggtaggctgtgttctccacattatagccctaacgggtgggttggaggacttgcttgctgctcttgtgggaccttcataagcccaggattcaaaaggaaccttcaatataactgagactgaattatttccagccaggcagaagtgccagaaattcaaagagtatttgggaagcaaggcatatgcctgccgcttaagttattcttgttgttttgaattatgaactcctttgcttcaggtgatgccccatctggcctggcatccaaggcaggtgagaatttcctccaccaggctttgcttggcctgggatgaggaattcgactggaatcacactcactccaccttcccacatccagacacaagcagtcacctttagggttttgcctctctctgttccagacagctggttccagagtcagctgtcacaactgaccctgacagctctagggagaattagcaaggcagaggaagggagtccttggacagagaggagggtggacaaggaagagaggagactttagagacaggcacatcccacaacctccggtgttaccatatccagcaggctgactgagccgcactgagccctgggcagaagtgggtgatctctgagctggggctgggtttcatttttcttgtctctctgagctcagccaccaggcgatacccaagttagtataccccacccacactgtggccgtgtcccagtgctccaaacgccacattgaagggagctggtctcagactgcagagctcacatgtgacagacataaccaatggggaagaaagagtcgtcccctcatgagtctgaagccagtacctaaaggagagaatggggaggcggcaaggcatggccccacagcagaggtcggaaggaagagctcccagggttaagaagcgaagccccgagacacagccaccattcccaccaccccagctcagggctacctttgggacccacccaaaactcagctaaggccagggaggaggggtcctcaaggacaagctgcaggcaccaagccctgccatcaggcactggccagactggagtgagaagccctgtgagcacatactcgctcctctacttgttggtcttggttttacgtgtcaaccgaggaaacagggccagtgtgtgcaatcgcctatggttggaggcgtggtggaaggcgagccccttctccccaggctttctgaaaccatgtgggagatctctaccagagtgacactgcctgcctcccatccccaccccccactgctggtggcgatgggacagtccagagtcctagtttgggtaggacagaaccatagaaaggcaaccccccactccggagtctcattccctcctctctgggtcactttgacagtcttgcctgctccagcattctctcggggctgtcggaaaagtgacagggagtgggcacagggttagggaggtgagtgtgggcctgctgctccatcggcagtgccgtgaggaagctgctgctccttctccagttctccatctcctgcatttcacttctcagctagatgtaagtggagaagaggaataatggggtgttatttatgagtcccttaaaacctcaacaaccctaccatgtgtcagacgaggtgcctggagctttgtcaatccctcgtgtcattttgtgccataactctccaggcgggaattatcaccctgtgcatgtgagcctcagtctctgccattcccacccctgcgctctttcctccacactgcaaagtccccatcggtaggagtacacttgtctctcagggcttgggtgagaagccctgggaacctcatttggtgggaagcttttgtcagctgcagagcatcaagcaagccttgggctctagattttgctgtgcctcgcattgctgataatccaatggtgtcttgcctccagctcccgaagtccacagatgtggcagcgatcatggccctgttccctgctctcctcagcccacacgttccccttagatgacttcatcggccacaaggctccaattaccggctctctgctcagatttatgtctcccgcccaggctgtgtgcagggatccaggtgcacacatccaatcctgtgcacacctccctcagccgtctgacagctgccgaagctcccaggtctacatccacttgacatctgcttctccagatctgctcctccagggtcctccagaacatggtactgtccttagacactggcccctctctcaacacccgtgtccaatcaggctctgagtcagggtaggtcaaactgagaactcctggccctgttcacatctctctctgcaaaggccaacatggtttctttgcccgggttatgtgctagcacctaaactagtcttccattcccaccttggccccatcaaatccattctgtgtactacccaatataatagttcttagacacaaatctgatcatgtcacacagtcgtttaaagcccttcaaatcctcccagtgcatttggagggaaactggatggctgacgggggcccaggcactacagggctggcttctgccccttcttcagaactccagccacagaagtctcctttttgttctcagaagcaccggctctttcccatcaaggctcccacacgtgtgtccctctgcacggcctctcattcccacactttgctcagccaactgcggccaccttcagtctcagatggcattagatggcacttctgcagggaagcccatcgccctccagattgacctgagaccccccgctctctggaatacaggaagactgaaaaaaccttactgtgttttgaactgtaatgtgctgtttacacttgtgtaatgactttcttccgtgagggattatggtgccttgaatacagaaatcagggcagcctgtttctcaactgtgtcctcagggccttgggcaggtctagcatgaagcagggattagtaaacatcaatggaatagattccatggaagaggctattaaaataagttgcaaaatactgaatatattggtttttttagtcaactataattttagagcacctgtaggttcacagcaaaaactacagagatttcccttataccctctgccccacacatgcaccgcctcccccattatcaacatctcccgccagagtggtgcatttgttacaattgatgagcctacagtgacacaccagtatcacccagagtccatgattaatttgagtttactcttggtgttgcacattttatgggggttaataatgtcatgtatccaccattgtgtcaagtgagggaagagggccagtgtgtgccatcacctatcattggaggcatggtggaggatgagccccttctcaggctttctgaggccacgtggggagacctccaccagagtgacactgcctgcctcccatccccaccccccactgatggtggtgacagcacggtccacagtcctagtttgggtggaacagggccatagaaaggcagcagctccccaccccgaagtctcattccctcctttctgggtgagtttgacagtcctgccatccccggcactctctcaatggtatccacatcgtagtatcacacagaatagcttcatggccctaaaaaacctctgtgctctgccgatgcacccctctgtccccccaacccctggcaaccactgatcttttaattgtctccatagttttgccttttccagaatgtcatatagttagaatcatacagtgtgtagccttttcagagtggcctttttcacttagcaatatgcatttaagtttcccccatgtctttccatgtcttgacagctcattgctttttagcactgaatcatattccatgtgcctggatgtgccacagtttatccattcacctactgaaggacaatttgatgcttccaagttttggcagttatgaagaaaactgcaataaacattagttttgggggtgctggttgtgtggacataagttttcaactctttggggaaaatgccaaggagtgtgactgctggatcctatggtaagagtatgcttagtttttaaagaaatgtcaaactgtcttccaaaggaaactgtaccacgtttcattcccaccaacaaatgagagcattgttgcttcacatcctcccaacattggtgtttcccgggctttggattgtgttcattgtactggtatatagttggatcctgttttaatttgcaactccataatgacatatgacattgagcatctattcaaacacttatttgccaacttgtatcttctttggtgaggtgtccgttcacgtcttttgcccattttttaaatcaggttgttcgttttcttattgagtttaagagttacttgtatattttaggtgatagtcctttgtaagatgtgtttttttcaaatttttctcccagtctgtggtttgttttctcactatttcgaattatattgacttgacttaaggacaaaaacaaccctattttaaagagtttgtaatgagaatgagtacagcaccttcttcctagatctagaagcagtgcacagctgtggtttcctaggctttcctggccattagatgtgggtttgtcaggagcccacactggcctgctaagctgtggccactagtcccacgtctcctgggctagctgtactcttttgaagccagtgcctagactaatgctttggggtagaaaggccgaaagtcctctcactagagactccacctgacaggcctctctctccagggaggaggtggtggtgcctcaaagaagaggaattcccactcttggtcattctagcaagggacaggaaatgagattagtgactgggtgaggcacagggacttatttggagcattctcagggaaggggaaggcaatcttactccctgacagtgagggaggtcatgggagaggcagccaggaagcccccttgttccggtccagggagctcacccctgacagaggcagctgagagttgatatgcctgggttgatgactcttgcacccatttaatttaaaggataaaggtaggctgcagtgctttggggccaggccacttggttttgtgctcctttcaggttttttccacggggactgttgtgcatctcacagcactccacgtgcctaagactgcaattgtgggtgcatgaggaagacagagcccctccaactcttcctgcccagccgttggtgagaacagagccagagctggagctgcaggagaccttggtgcagtgcccagtgcacactgccctacctgacaattctgttgggatctgggggacagccaggatccagaggggctggaggaacagaacaaggccctggacataggctggccacagagcaagcgcagccaaagaggaagtgctgtgcctggtttctttccgccctccctcctccttcttccctgttaactgttctgctgggagcctccggatcatggattagggattgtggtgggaccctgtcagactcaccatgttgaagcaggtcaccaaaggtcacacagttgcccaggatgagaatgcctgtgcccaggggtgcatcaggtagagtgaggagctgggattggatcccttggccaggctgctgcttctgcaattatccagctaccgtaggacaggaataaaagaagccacagaaatcaaagagctgaggtaagcaggaaggcagggcgagaagggagggcccaaaacagcctttccccaaaacagactttgctcatgatgatgggaactgtcgagtcttttgagggaccaaaagggggacacagtagcagagctgaagggccttgtcctccaggaatcaggaaggaaaggaaactaaggcagccagagtttatgggtcagtgctgggccccaaagcccaaccgtgcaaagggttttggctccacctccagcaaaatgatgtctgatgatgtgtcccaggatggggtctctgccagccctcctactcattgatgctcaccctgcacccagaaccactcaagaagcagcgggggtgggatgaacctccaggatgcctgcaggtggggcagattcaggggtgaaattcagaactgatataagaaatagatttaccttgaagctaatgatgcttccagcacaggcctctcatttgtaggaaccccttccaaagccccaggagtggctctagcaatcaatgtaagtaagaagataacctctcattctactgggacctcccctgtgtcccacacaatgcactctgcccccatcaggtggcactggagtggccccaggcatatgggggatccagagaggttcagctgagaatatgttatttaatctataatctggaaagatgctttgaaaagttgcaataaaacaaatgagaagttatggtcttccactttggacagaaatatgattttgtcatccttaaatttttaattaaggaacagagaaaaaaattagataatgattaatggggccaggcatggtggctctcacctttaatctaagcactttgggaggctgaggtgggaagatcacttgagctcagaatgttgaggctacagtgagctatgatcacaccactacactccagccagggtgacagagcaagaccctgtctcaaaaaaaaaaaaaaaaaggaaaggaaaaaagaaagaaagaatttactgttaataaaattatgtttttaaatgttcatattttaccatgaagaagtagaaataaatgcctaataaaaataataatcaggctcttggaatatttagtaatctaatcaagagaagtgagtcctatgaagacattggggaaacttttaaatttattgatgaattaatcaaaactgacaaaaacaaagaagacactaaacatgaataccattaaaatgtgggtctagaagtgtatttgtcattcagagagcatttcaggtcagtcaccatacagaaaatttgacatgccctaaagtcatacagctcagatgggatagaaacatggttcaagtcttccctaattttttcaacaatttattataatttatatgacattatcaattcatcatgaagttgaaataaatttttctcaactaccgattttttcagaaaatgttgtttgaccagcactgccagaggaaagactgaaattacctttctattatgactctagaaaatcattgtcatatgaagagggaaacagcaagtacctagccaaaaatacaagaaggaaaatattacacagtatgtctggaagccagtaaataatatgtttttgcagagttttgtgatgtttacattatttatcagcttttaaaaaatgtgtagttcattttaattcttgtatcattttgaataagtattcacttttacacctagttttgtactcacaattttgttatcctttttctttacaaagtcccctacatttaatatggaatcgtagaaactagatggactgtgacagaggtggtgaccaggcatgggtgcagacacaaactctgcacggcctcagtcaccttagcccagaagccacctctaggccctgggacaaagagccaacctaaccacccgcaggcgtgcagccctactggcaggcactagctctccatcccccgacacctccccatggctcaggcgcccctgattcaaatggggaatggactggcatctggtcactagatatctcgtccccagattaacttttgagtcatttccaatcctgttcttttttaaagactgatggtgtgtactttcacactcctggaaagcaaataacatgagtttctggaggacaaactggcaatacatattcaaagtattcatactctttggcctggcaatcccccttacaggaatctatgaataggaatgatcagaaaaacagacaaatatgtaagcaaaataaggttcccacagcattgcatgacacaataccaacagtgttaacagaaagaaaatccttctgttatgtctctcccttgtcactaggtatccacagcctgaagaaatttaccaacatattaactaaaatgctctgagtggtacaattcggaggatggttgttttcttctttatgcattttgtgtgtgtgtgtaacacagatgagtttatcagaagaaaatgcacttttaaaatgaaacagtcgtagaaggaaatcaatcagacacctaaattaggaggctgacacaactgctcccaaaggaatgtcttagtacccctcagtatttctttaaaataaatggcttcagaaggctaaaaaatgggcctgcccacctcttttctcagggatccctagagcctttgctcagacactttgattcagtaatgctcataaatatggagcggccctttgcaagatcccttgcattttaatgtgggggtagtgctcacctcctccgtggatgggtgattgcaagcagtttcttggtcctcatttctgcaagagccagtgaggtgtgtggactgggatacttaagaaggagacacatggaaatgccatcttctgaccagggagtcccttggaccttggaagcaaccagagagcagagaaagaacagtagcccatgcagatgaacttacctccctcttctggccttgctgttgtcttctgtcaagtggggagatgactctgagtaatctctgagggctctccaattctgcacatgagcttcctacgagcagggaagttgactggcatggtggctcatgtgaaggccatggggaggacagggagttcacccgatccagcgcggatgcccttccttcatcttagcttgggcgggttagtatttctcatcctgaagtcaagctacctattctggtctcctggagtctcttctgacacaaggctaagttatgtaaatacacaaactaaacatgctttgcaggcataattttttaaacagagatgaggaatagagaaataaccaaaaaaattatgtacctttctgtgcctggtttatgtctgatttcacagaatccagcagactgtatacacatgggacaagcctgtgaacttggctatcacctctgagtttcagagggtgggtgacagacaaagacaggctggcgccacaacccagcacagcctgcagaggacacctacacatggggactcggtgtgggtcttggtggcacaggggagtctacattggccaggggagccctggggcccaatctcaggaagggatgtgccgcagggaaaatggagggccagaggagatcaaggtagagatttgtttctgtgtacggtgcagagagaggtccccaggtacaagccaagatgtcacaagtgcagggtgggtgaaaggcatctcagaggccacctgcagggaaggatccctactgacctgggcacctgaacacagtgtagcctgcaaacccgtcctccccagaggctctgcacccacacactctctgatctccctcatctggacttttataccaaagaggttttgatgcgcctatcagcttgccaaggccactgacagccacagaaatgcggtggagccaaccccatccaggggtcagtctttgatcctatttattatttagaccagtttgtgacttggtcaatacagatgctgcatagccaggaagcactgggtgcaggcttcgagctcattcccacagatttagtggtcagagaggaaagggcaacaccttggagaagcttgggaaattgaggcccaagagatgaagtccaggggattaactcgctcagcctcaactggcaaaatcaaatttggaagcagctagaaaaccacattgtgaataatgtagtctggcttggccccccacattgccttgtcgtgggcttccaaaccatccacttggaagtgccccatcaccagcctctaatgaaatgcaattggtgttcccgaccacgttcctaccttcaccagtcccagcagcccctcagtcccggccgcacacacttgggcacgccatgccagctgcaccaagccaatctgctgtgagatgccgggaaacggtttgcaaatattactttccaaatttatcacacttggcctggtaccgtggaaaaagttggttttgattttactgtggatgatcctgaggccccagtctgtgtcctactggggctggcttcgggtgctggggccgaagcctggtctcagagaggggccgggccttctcaagtggttctgctgccgagaaaggtgccagcccctccactgaccactggccacctgcagaagcccacctggctacactggccctttcctggcactttccaagccagcgaaggtgacctccctctggcaaacagaaatctgcgctgttgggagacagagcagtaggcatctatctccacatagctatcttgagcacctggtatgcaccattttgttagcatggaactctctccctatccctatctcagcagcttccttggagccagcagcaggcctgaggaggaggagaggggagtggccatccagctgtcaagatagaatccacaggccccataggagggacctggctgcccatcatagacactcagtctctcgctctgtggctgtcaagctcccaatatttctgtctctctcttcttttctgtctttatctgtatctttctctgtgtcttcttctctctctgtctctgtctccctctctgtttatccttctctatatctctgtctctgtctgtctctgtctctctctccctctttccctcctctccctctctttttctctctccttcctccccctttccttgcatttccctggggatgatggagttttcctccacgtcaccatgtggctagacaaatcagccctggcctttttgctcttgcatgagagtagaaggcctcccaaagcccctcaggttccatggtgtctgctccagccaggccccccaccaaaaccctctgaatcactggctctggggatggcaagagccctctttccctggtcctcacactcagtcccagactgttgagactaatgaccttgagtgtgtgtcacgtccctcatgtccccctctagggaaactggccagagtgggaaatcacagccagattttgggtcatgggcaaggggctgagggctcatgtctgtgaagagaggggcctcgaggggcccaggcagggaatggcagtgccgggagcactatggagagtggtggggtctgcaggaacctgccaccaactagattgggcagccgctctcctgccgcacgtctcctttcacatctgtggccagagtctccaacttttcaggagaaactgcagatctagattttcatatgaaaatgttaagacataattcaaagttttttgagaagcactctgcaagccaaataaaacacatcagcaggacggatctggccagcacagcacattcatgacctctgtttggtgtcccctaacacccacccctgggccccagccaccttcagggctggcaggggggcctctgcttccagggcccatgctcctccctcgccttcatcctggtcatggggctctgccttccccggagctgtcccagtgttcagatgaccctgaggcaggagcccacctgcagtacagcctccaggctggtcagccggtgtagacatctggtcattcttcatgtctgtcacctgcccagctggtcacaaagcagaggtccgagccccaggaaacccaggaccaccaggctgtggaggagaaagacttgctggtgtttcatggcccttgtttgctgttaccaaagctcatgtttaaacacaattactttctgctccactcaggcaacccagttggcacacccttccagggaccaagtcccatggcctttaaggaagccctagcatggggctgcccattccccagacatgaaaggcagctagtaagtttgctactcattagctgtgtggcctgggaaaatgacttagtttggctggcctcagtttcttcatctgtaaaatgggaacactatctcatgctagataaaaaaggacaaaattagacaaattagataaattccctcccagcttcacccatgtgcagaaatccttgaagaaggagaaggcgaaggagaaggagaaggagaaggagaggagaaaggggaattaatatttgttgaacctattatgcatgaggcaccttgacaagggcttacaaatgtcatctcaactcaccctatgaatcaccctggcaggctatcaccccacttcacacagcccctatttccacttcacagatgaaatcctgagctccaggtaagttgagctatttgtccccggaagggcccaagatttgaaccaagattcaaatttggtcggtctcaacattaaacctagaaacccggccagctgcagtaacccccctgcagtgccttcagcctctggccctggaccgacactccctcccatggctccaacatgtgtgggcccaggctccagcgccctcctcaggggctgccctgcctctgctcttgagaggacctgcaggcctccatcacccagcccacgcttcctgtctgtgttgcaggggtgcccaacccagtgctggcctcttcctctcggtgttgcaggcggcctgccaatgccattccttgactcaaatggactctgtggacaaaagaacactcccccaactactgccttcttggcccaggcaactccttctcatccttcagaacccagttcagacatacctcgtattgggggctgtgcctggcaaccccagctccccaggctgggctgaatgcctccctaggccacaccagcacccaccttggccttgatctcattcactatcagtgagtccactctgcagtgaggggcaacgctgagctgaggtaaggcagctctcctggggccactgccttaacctgagggtcccagcagctgtccctggggcccctggtccttgcctctgatgccaccctgtgctgctgttacccactctcaagcaaaccacaccctggtgggaggccctggggcggcagaggctgtgaggacagagcctgaagcctctgctggggtcccaccctgagctctgaaagaacccccaaatggaagcccccaccctctgtgttgcactttgcttttcccatgtggccacaggtcccaggttggggactgggccaccttcccttcctcttgctttagtttcatgcccagctccgggtgtcttctcgtcggggactctgcatgcctttctcagggctgagcagagctgaggggtccaggagccctggttacccccaggtgacatcccgtggtattgttagcatggaggtgatgtagtgaagacgggttgtcagctaggatgggggcgagatgaccatctaagcaatgtcagagcagggcacgtactcaaaaatgtacaaacgtatcttccaatcttccagctgttgggagagcttgggccacccaagggcacagcgccccctgctggccatgacgatgatgcggcttagctcacagggctttcctctgcagcagctccccagaagccaggcaggggagtgctgggcggggtgggagagggataggggtgtgcatgcatgggccatttctcattctctaacatacaaacgtgctctgacacctctcttgaggaccccctgtgcccactggcaccaccaacaaatcaatcacatagccaatcaacaaattaacaagcacctgcagtgtgcacacactggcccagactcaccttacctggatgctccccacctccactctctgtgttcaatttgccatagtcctcctgccccacctcccatggctctcacccccacagaactgccccttgtgccttcctcctcaaccaggtcctcacgcccccaacaggacacatacccagggcccaaccacgtggcctatctctgcactctcctgcacccatccatcccgcacaccacccacactccagtactcttgccaagaatgctcgagcattctcaccaccagctccacaacctccagggcttccctgtccttgagaaagagcccagggaaaggcttgggtgatcagacccaacctgcagacgcagccctgcctgcctgactcccactcaatctgccctctaagcaaactgcagcagcacagcaccattcccagaaagcacccttcacagcagcctcccacacatcttcacagccccccacctgcacaggcatactcagcctcacagagtccccctacagccctgacccctcgttcctatggaagactcacgccgaggccctcgtccattcccattgcacatggacccaccaggccactcacctcttcatctgagcccccacacccagaagcacccatgccccaacaccctctgtggtatccaccctcccgcccacactcagggttctgtacagaaaggagggatgcagggagtgtggtgagcataggccccgacgcccagtttccccagagaagcctttcagagaaatcgctttcacatggcagctttggtcctccgggagggcagcggctgaggagggggcatgacggggcagccagcgagaccattgttcacgccttggctgctggagccaagcccctaccccagtgccccttatccattggaggaggccgcaggaaaacaaggtctggtacccgaggggcccagtgacccgtttaagcagctcccctcaagcagaagtttcccacatgaccttccagccgggccctgggctttcctgcctccacagcaaccgcagtcccctcgcttggcactgtgtcttggcccagggcacaggggaagggaggaaatggggaggtggggagaggatgcacaggcctagcccgggctcccagctggcaacagcccttcttgtaaggacttctgggccctctgggtcctctgaccacctctttccaccacccaaaactggtcatggcctgcatgggtttggggacccagtgagctacactcacatcactggatgcttcaaagcagctgtgtgactccaggcaagtgtcaggaccgtgggttcctcatgccctcctggctatcaagcttgaagggcccacgtggagattcgagggaaaatgcacactcaggcccaggagcagtgcctcacaccagtgagtggagttcccttttaacatattcttgggtattgcctccacctagggtctgtttgtccccaaatttaagcttcctgggttctgactatgttgggcccagtggtgtggtctctgcccagctggatgtcagcctcccctcggcctcaagggcccagtgctaccacccatgtttccttaccatgactctgagcagtgctggtccctctctgagtcccaggaatggtgcacttgtctgctaccggtatctccactccccaagaaccttcctcacccatcctactgggccacccaggacttctggccctctctggacttctgacaggctctgctataagcccaggctctccacctcctcacacccagcccctcacagggccaacgcaccttagtaggtgcttggccaagggtggcagggccatgttcaatacacagatttcctctatgagactttgcggggaggacagagagcttgccagcagcctggcctcttgtcccgtgccctaggccctttggagggagcccctgccctgaccctggggcctccctacctcttgcactattgcctggccttctatagccagcccctcacacctcccaagctgtggtcacgtggaggccctgccactcacgggccatacctgccatgtcctcggagccttaagatgcaggtgttgagagctcggtgttgcctgtaaaggtccccctggaggggtccctcccatcaggcctggaggctcgggtctgtatacatgcatctgcatggggcatgactggtttccagaacctcagagcccaatccacctgcccacatagcccataccagctgaccaatgacagtgaggcgaatcaccagtctcctcctcactctgaggcctccctgcgctgaccctgtcctcaacttttgatttctccttcttacagcccagctcccacattggactcagttctgtgatttgggatctggccttgacctccaacttgccccagattgtgccttggacttggcccagtccatgctcaggtgggccacccagagccactttgggcctctcagagcttatttcctttggtgtttggtgctgtggacagagaatagtctggcggagaggggagctgagacatgcaggatgctggtgcctggaatggctggcactgagcccatcgctgcctggaaccactggctgcctcctctctgtggcttgtctttgccatagtctgtgagcttggggcccacaccccgtggagcaccatggccagacccaggcagcaaaggtgaggttggcccacagggaaacctgtggaaggctctggcccccaccccatcccaggctcaccctgcctcacagaaagcacaggagacccctggcactggggctggagcccaggacacctctcccaacttcctctggattatgaaatatatttcatgtgatatctcaattcttttcaaacaacatggagtgacatctgcagggcactttcctaatgctaaacaccttgggtcagcagtagaaatgcctccagtcattggggtggctcctaatcttcagatgtcaggcgccagggaacccaacttagggactaagatcctcacttgggaagggtcctgggggccatcagagggatggccatcactcacaggtgagcgagtgtgcacatctggattcatttccacgactcaggatcacatcaggcagcatcaggggccccaggagggatggaggtcacaggctcccaccctcgtcttagccctggaaacatgaaggcctccagtgccctcctccagtaaccccgtgagtgcctggcacaacagtgggcactcagtgaatgccggtaagtgcctgttgaccagagctcatatgggggagtgcacctctctggcaagctggatcccatcagtgtcggcccacatgtgcaccagcctcgtttcagctgggagaatcgcatcaggacaatgggaaagcttctccccgttcccctgccaggtgggcccaacgccagagccgcgatccagggcatcgctgctaagtttccaggctcccgtcaggcatcactcccacccagggggaccctgcactgtctcacttctttagagacagatcaaattggagagagttggctcacatcaaagacaaggcctatgttgtttacacacatttttttgggaagagggaacaaattattttccttcttgtccatgggatgccaatgatgagttctggagaaccactcagagacacctgtcatgaattcccagggcagggttagtggagatggagcaaacagcccacagcgcaggctcctgatttagaagggaaagtgcagcatggattctctaaagtccagcagcagcagcttgcaggagacactgcggcactcatggtgccctgaaagttgcacgggatggaggccacaggggacgatgcatgctgatgacatggcaggaagggcaggtcttgactcagcccaagggagcttctacccggggccgccgtcctgcacttctgagcatattcatcagggacaaggggagaggcaggctcatggccctagggtctgggtccccctgacacacccacacagtggtggagccttgaggacagcctggggcctgctgcaggtgtcccagggaagagggcatgggggatctgtgcctgcccacattggaatgcctcccccatgggaagcactgcaggctgggcaactctgggggaaatcaccaggagcctgcacagaggccccgcccaatgcactggagcatgaagcaaggagcgtctgcctgccctaagggcaccccatctggagagagtgactatggcactggccatcctgtcagccgggagcctcagggaacaaaggcagagagagcccccagaggagatggcagctcaggtgagcctcaagtgatcacctgcaaggaggggatttccacagaggggcgtgagtcgacggtgggatgcagcttcttttattcatttatttatttatttgtttggccaaaaagaagaaagaaaaagtcccactcatctttaccatccagatcacattgggcagaggttcaaggaacctgcgtgtggcaccctgggtggaagaacgctctggtcccgacagcagtctccctctgctgaggccttccctgactccccaacacccgctccccatttcccttcccttctctccctgctctgcagcctgatcatcacagacgtagtgtgggctccacccatttttggagaccgtcagcccttccatggcagcaccttgctttcaccgggctcccagtcttgagctctgccctgagtgcctcccatgcacagtgctcattcattttggttcattcagcaccttcccattttacaggtagagaaacataggcccagagaggctaagtgacttgtccaaagcaaccagctggcgcatggcagagcaaggactccatccaggcttcctgaatctgcatagttaacccctgggccatagaatctaaaatggtaacattatctaaggtctgggatttttgcagttgcaatgttcccagagccgaaaacagtgggtggcacataatgagatcttcataaatgtttgtgaaatgaatgtagacccagccctcctgacactgaatctgcaaccccccaacacacatgcattacagtgagagaaatttgtcatcttggatgcactgaaccacatggcatttcagctcagggtccccactgtctgtgtcggaagcctctggggcctgggaaagcagcacaccccataccctcgagtaagggtaaactaccaggaagcaatgtcgggtgcagagagcatggcctttggagcatctgctggagtcattttcctgaccctttgtccttctgcccacagttctctccccttctcagcacagcatggaggtcagaggccgccgtagaagcctcattgaagagaagacagtctgtactagaaactcaaggattagaactgaggttgaatcccactttcgcacttggaagctgtgtgatcttgagcaggtgttccaacctctctgagctccagatacctctggattgacaaggtcagggtttctccctgagaagtaattttctaacaccttgacatacacactctcctggcctgtgtcctggaccactgggccagtttcaacccctctgctggagacagcagcaaggtccctggacgatccctatgttcgaagtctgcttgccactgcctccaacagcctgtctgccattccccaggcctcagtgctattctgtggtgagcacagaagtgtccttgcccagtctcagtttttatttattttttattgtcagcctcagttcctaaaatcttaccacgttattagaggaaggtatatttttgacaactttatccacagttaccttaaatcaaggtgtcatatacacagtgccaagactgaagatgtttttcaacataaaaatccattttgttgatgcaaaggctgttgagaatcccttttgaaatttcatcagccagtactcagaagacttttggatttgactaacacagaggaatctcttcttggtaaaggacctcagatccagatgttgttccaatggaaaaaaaaaaaaaaggaagaagaagaagaaaaagaactttttccaacattcctttataaggaagctggtgctggggatatgatgtccactttactgggacaaaccaaaatatcttgataagtagaaaattttttttagcaaataacctgctgttggaaattttttaaaaaataaacacagtcctataatctatgtcaagttcagtggtaaacatgaataaaaagaacttaaagaacttaaagagtcaagcgtcatctgggtaccagtaaactcaatgtaagtggtgattcagcaagtgagcttaggtttttaaaatgtactttcaatttttttgttaacaagaaatgagttaacttattaataaaatccaaataaaatgtaaaatgtagtaaggttggcacaaaataattcccatgcatgtgaagtctgcacctgtttatctggggggactataatcttgcagaaacttgaaacatcctgacatctttagtatcttgctctgcaaattgggaattacagcacctacctctcagagttgtttgttcacttcccctgccccacattccaggtgaacccccgacagtgggtgcttgcttccccaagccagaatttaggtccaggtgtgtgggtccttacggcacatcctaagtgacagcatgcaggttctgcctctgaagacagcccttccctccttccctttctccctccctttactccacacctccgcatgagcatctagtgggcacaggccaggggcaatgctctaggacttggtgatacaacagtgagcaaaatctctgtcctcacagcgcttaccatgtagaacaagaagaaagatgctcaaggaacacacagatgtctaaagtttaatgcaaataacataaaagccaagataactgagtcccaggctgttccacccttcccccttttaaaacaatcccctctgctttgcatgcaggcttctctccttctaccctagcccaggtgagggcattcagagagctccagggggcatcaaatggaaggggtggctcaaggtctcaccagcttgcagcctcagcggagagcagtcactgcccctgtccagagtccgagcaagctaagcaggcttgggtctgatcagcatccaccaacaacgagggcatgagggagggcgagtgtgcagagggacaggccacacttcttccaatcccatgcgtggaggcaggcaggtgccctgctgtggctgtggggcaggactcaggggatggaccagctccaggaatgggtatggaacagattcacatggcccaggtcagattcatgtcacagcctggtgggcagcttgaccatgccagcaccagagcacaggccctgccatggaggctggaacctgtgggctgggctgccaggctttgggcttgcggagcaacacacctgccactcaggatggggttttgtctacggcgctgccttgtggacagtgagattggatgggggagcagcagagcagtcaggaatgatgaggacacggggtggtcctcaagcctggtccatctgctacggcaagcctagtttgggacttaaggtggctgcaccattgtagtggttattacgtgggttttcagaaccagtcttcggatcaaatcccactcctgctccttctcagctgggtgaccttcagcaaggcttcctcatctgtaacttggcaacagtgacaggtgccttgcaaagctgtcttaagaattgatgagatggtgaaatccaaacctcaagctaaagcaagtggggagaaaatggtcactgctgtgaacagacatatcagcagcagctgtggtgcatggcagagccgtcccccctgcagcatcattccacgaggcgtggctgggtaggccttgcggggccagcacattctcaccctgcccacctaccaaggcctgtttgtgttaatgtcacagctctgaagcattatcatcagaggccatgagatttcaaaggagcttcctttgcagagccacattgctctgtccataattagcacaagtttccatgagcatgacgatgaggccagaggggctgccctgcaggctggtttgttagtgtaagacattcctggggcatctgcgtagcctgggctatgcttttccagccctcgctccccctggcccctgccctcagcagcccccaggccctcattaagggattagcgatatgggccatgcaatcccttggccatctgcttgagaagtgctgggttctttgctctgtcccgcctgaaccttatcagtggtcctcgcgcaatgtttgtgttgcaaaaatcaaagcaggtcttgggcggaaattatagaccactggtgtcatgagctaattaaagactacggggtcatacacaagggagaggacacagatttctcccactgtctgtccttctgctaatgggacattgacaagcacagaccaggaagaaggctgagaaagccagcagcccgtgagagtatgataaaaggtgacagtgacaggtcttgcttcaccaagtacagattgggggatgctcctatcagggcccagcacccgtcacaaagggtgtggctgtggggcctggcggcaggctaggggcactcccccagcagccatccagagcctgagggaggggatctgtggggggacagtctcatattaatggcaacacatttatgacccaggaggaagtttaggacagttctgaatgtctacatctccatcatcaaaacagattaaaattcaagaataatcttgaacaatggaaaatagacaggcagggaaaaaccaaaatgtaaccttgaatagcttctgctgttgttctctgtttaccaggaggctgtgagcttcttgaagggtttggctcccccacatgcgaggtcggggactggggtgatctaagtgagtgatgggagctcaaacccttgcacatgggatgagataacatccctaggtaccatttgaatgctctctccccctccacactcaccccagttcccagccccaggcagatggaccagactccaccgctgaatctaaagtaaaggcggcaaatgtacgaccactagggtcaatatctggtgacttaggtcctgatgagagtgcttgccatgattcctgcacagagggtgatcctgtactagaggactggctccaaagcttccaccggccagggaaggggtcacaggagcacatcaccacccaagcaagtgtgatccctgccaggactagcagtgctgcagtagccttgcccactctcctgcggtcaggacccctcagtgatggcacacgtcatccagtttggaaagatcatccagcctcaagactgggcagcacctcccactcaatgcacccatgtggccagcccactctaggggtccgggacacgcttctgtctgggtgcgggggtattcgaggggggactgccatgtctgtcagggagtgtgggaagcagatgctgtaaggtgcaaaccagtaattttctggggacaccttctgagcccctcccccttccttcagccattctccatgcccccttttgctgagcataatcctcaatttctttattactcaatccagccttctctggcagaggagtatctactattttccaggggaggcttctcaaaccaaggcctgcaggcgaaatccagcctgctatctatttttatcaatgaagttttattggaatgcagccaggttgatctgtttatgcactgcctatggctgctttcaggctatgatggcagagttgagtggttgcatcagagaccctacggcctgaaagcctaaaatatttactctctgactctttatagagaaaatttactgtctcctattctaggaggtatagaaaaactattttagtttagcctcataatgtccctgggcaatagacgttgattttcatttgaaggaaagccaccaaggcttggcaaagttaaatagaacccagctgttagggaagggaggtgggcctcaaagccacatgtactaactctaaagactgtctttttggcatttgtcttgttgcatctttggcagaataagccgagggtgaaatgttgccttgatcctgttgctggagcagggctagagcttttacacctcccaaacctgcaggatgtctagtaacagcccccaacttttctccatggaagtcccggttaaaatccaaagacaaatgaccctctccatattatcctccaagatccaaaattactcattcaaacagctctttcctcttctccttaggtttgtgacataaaagtgtatccaccagtgagcctcttcctcctccctttgatccaggcattgtgtgtgcatttggagcctgagccaggtgggtaaggtgaccctggatgccgcacgaggtcctttttgggactggcaggtgcctcttcactgggcagtggagacgcaggatgagggagttgatttgtggctatagagaagctgtcagagacagaacctctggttactcagtgatggccctccgggagtcaggaacccaacagacctcatctttagtctgtaggatcccccagaaagcagacgcgctgggcattagagtgcctcttgttctctctattggctgtcaagcctctgaacgcccttagtgcttgaagaactggccccagcatggatgagtcctgcaggattcaggacctagctgctgctacagacacggagcagggcagtccagactcagccatctttctgctgctgcacccacctacttgttacctgaactctgccacccagcagtaagctctgccaggcctcacagtggggtggtggggtgtggcccacacctcgccaccacccacccccacctccaggttgacctcggtggtcaagcttgccttgataccttcctgttctccaagcctgtgctccaggattctctgtcaaccaccccatctgttcaataaattcattttctactaaagtcagcccacacctgtgcagaaacagggttggagcaatttaggtgccttgtccaaagtgataacagatgggaaaaggcagagctgggattcaagcgcatctcctctgaccctaacaagcacaggctgctctcgctagccacacccctctcaaggagcagcactgctctttctagaccctcagaaatgggccacctcccagatgccaggtgtgagtgtcctgacacctgcccctcactctcctccccagccagggcttctctgatgaattttcccaagtcagcctcttgaactacctgccttcctgggaaacaccttcaaatctgcagaggaccaagtgggctccagaaatgaaagtggagcatttcactgtgtgtggagcagtgagaaagggagagggtaggcttggagagtgcagttagcctgcattgggcatcctgacccgtcgggccccaagatgggagggcacaggagcctccagtcacaggaggtccttggggggacaatgcccaaggcctagttgaggaagggggcagagagccggctcccagcacacctgccaggccccacacctgggaccttggggtcccagagatttcttttcaatgcctaaagctttgctctccgagcctaaggacaagtgggcaggacagggcaggatggcatagacttgacctccttccccttgtcccaagttgcactctccagacatgggctggctgcacacatgggctggacactcagggggaaggtcagacttcccaatctgggaccctgattttgctgttcatggccaggtgtctgtcccttggctgtcagctgtgttcaccaggtgtgtgtcccctcagaaggtaagtggctcttccagtgggagtgttgggagaaggaaggagaagagcattctgcaggcatccgccctgctgcaactgcgtgtggctgagtgccccacactctgtgcccagggccacctgtctcccattatggctgaatgtgctaatagggagattccagaccttagttcccctggtagtaaaggtgaccctgcagctccatctcaggggtgtggctccctgaggcagtctttcacccatgagagacttgcccaagatcaagacagcagaacactgaagctgagctgcccctccaacccagctctcgccgaccccaggaatcagggggctccccacttatttcctcctgtgttccagggctaaacattcggctttacacacacacttacctgcatttaacacctccagtcatcagccctgcttgaatcaagttgcctatgtgccagggaagtggtggaggtgaccgctcctgaccacagtcacctggccccactgggcaggagcatctcctggccgggagcagtgagggtgggaaagtcattttctcaagcattggatgggggctggaggggagcagacatgctctgtggtgggctttgggaacacagattccttgttctgggtgagcggtcatgaggcaatccccatttcctcatctataaaatggaaaaagaacctgagaatgctggcctcatgacctcattgtgcggcacacacagggaggatcagtcctgtggtgggtgctgccccaccagggcaggtgctccggcagtgacggggctcgtccacagctgtggcaaccccgatgcccccaccttatctggtagtcattgtcatctgcatcctccctgtcattaacctccccatgccccatgccctcccttttacatcctggccaggctgtctgtgccagctcaccagcagcccatgaaaagcctggacaatgattggagagaacagtaatgaatacaaatcattctctgggcaccacagagcctatcttgggtgatgcagcctctgggtgctaaccatccttggtccttcctggaatggctgtcaggccactgaggccgcaggcttgatgaagatggatgatggcctgtgcctgggtaatgctgtactaacacagagcccagcgtttaatcagagctctgctctctgccagagccgagtaattggaggcaggtgctaagcacaattgaaataaaatgtggagttaataaggacagttgacaaggatgttacaagtcccctgtccaagttttcaacaggaattggaaggcaacttggagacctcagaaactgtgagttaatttccaacgtttctcttcaaaaacaagtacaatcaactttagggctttttttaaagcttatttattttcatatttgcaattcaaaaataagatggtcagaaaagcagcacatgtctaagatacttctgatgtactacaggggacaccagctccatggaggcctggacacccctcttcccaccttcatgctccgcactcagcaccagagtcctccaatctgcctctctggctgtcccttcctctcccagcccattcttaatggcctctgcatccctcatcttgtatcatccaggccattgctaccagcgcagtcttgctagaatgcacaactccctgcagaaagttctattccctcccaagtagagctaagccccaagtctccatggcctggcccgagctgggcccagccttatctcccactgctcctgttcccttttgctgctctagtcatggtgaaaatcctccacctgcctggagggtccctgccacctccactcttaatacactctctccctggcctgaaggatcttccgcccttcttcattgacattcccagatagtgccccaagagctgtcctgagccccgcgcctacttcctgtgcccacccatcccacggacagcactgtccatcacatcacaccctccacaggctgctgccagtgtcctgtctcccaacccgctagactctgcggtgcccaggtcagactgtgacacctgcaggactgcaccccgcatggcgcctgcaccccacgaggcatcagggatgcactggaccagcccaaggctgtccttgtatcatgtgctatcacttactagccagcacgttccctcaaagctgcatgggtgacattgacatggtctgtgcccaccctcttcatcctcaaaacagtcccagtttatgatttcatttcataaatgactgcccccccccaccaactaagaactggaaccgtaagaggcagatgaatgaaaggaaaacagatttaagcctgaaatcctccccacccagccagcaagctgtctcgagtgccctctcggctcagtcttcagtgaagtgacacctggtgaggatgggctgtggattgtccccctcaccagctaatacacctggattacacagtcacctggagaatgagcctcagggtgacccacctccatgtcaaggggaatcttgaggtccatgagacccagctcctatgtgaggggacccacctccgtgtcaaggggactcttgaggtccatgagacccagctcctatgtgaggggaccattccgcattatccccaaagttggagtgcatggagctaccatatgatccagcaaccctactgctgggtctatactcaaaagaaggaaaatcagtttatcaaagtgatatctgcacccccatgtttattgctgcagtattcacaacagccaacatgtggtcactgagcttgactgatgctcagtgtccatcaataactgaatggataaagaaatgagtgaacaatggaatattattcatccgtaaaaaagaatggaattctgtcattcatggccacatggatgagcctggaggacatcatgataagtgcaataagccaagcacagaaggacaaatatcgcatgtcctcactcatatgtggaagcttaaaaagtgggtctcatgaagatagagagtgggttggtggtcaccagggaccaggaaggttagggagagcaaaggataaagaggggttgattgatgggtacaaatatacagttagataaaagaaacaagacctcatgttcagtagatcaatagggtgacaatagttaaaaaaaaatctattgtacacttcaaagtaactagaagagaataattagaatgtttctagcataaagaaaagacaaatgtttaaggtgatgagaatcccaattaccttgatttaatctacacattatatgaatatttcaaattatcacacatacccctaaaatatgttcaactattatgtctcaataaaaaaaagttggagtccaacttcccccaagacaccccaggaaggggttttgtgatgagcaacagctcagagatcagaaagccccctctaagtcttgctgacatcctcctgtctctgtcggggagctacagagccactctggaagcaaatgctcccttccccacccctcaaatggagcagtcccttctggacatggttccaggcccatctttttcctgctcagccacagcacctcttcagaggacctcggtggggtctgcgcagcaccgaggaggcttcactccattcgggcagttctgcctctatggaagacagtggctcagagagtcagagaatgccctctggaatcttctgtggctctgactcacacccagccaaggccttccctctccccacccaagtctgaccatgtgaggagctttgcacacaatgtccctgattctcttgcatccttgtcctcaagccagagtggactcagcgaagtgcaatgatctgagggctgtgcttactcgaggcccacctgggcctgctgtctgctcctccctgctgctcccaggggagtccccccacttccccaacatccccagccccgtctcccctggctccaggctccattgcaatctgaaagctctacaggcagctcaaactcaggtcccaaatggaactcattatggatccctccaaactcactcctcctccatcccctgctccaaagaatgacatcaccaccagccggtccccacgccagaaacctgggaatcatttgaggtgtctctggccctcatctccacccctagcaatcagtcagcattgcggctgcactggcctgaggtttcctgagcccagcccactcccttgcccactgtcattccctggctcaggctctcatcttttgccaaggctgttaccgcaccagcgccctcactgtctttctgattctaagctggctccctgccagtccttccctagcacaggtctcaagatgatctttataaaggtccaacatggtgtgtcattccagctctaaatccctcaagggctccccctacatttcaagaactcaaatgtcttgacacagcaagggagaaccacgtgacctggctcaggcctgctccccgacctgggagcctttctcttctgcacattcaacactgcttttttctcactttgacccttgtatttggactcccttgtcctccatcctcatccctgggcagtggctctcaaacctaagtgtgcatcgaaatcactgtaggggcttgttcaggcacatacaacactgggatcccctcagggtttctgataggtgagtttggggtggagcctgagaatctgcatttccaatgtcaagttcatatgatggtgatgctgctaacctgatggccacactttgagagacagcaccaccactaaaaccttcaataagcgctcgaaaggacccaaaaatgctagccgaatgaatgaatgaatgaatgaatgagtgggatacactctggccagccaaagttttgcagccactcgttaggactctgttgactggatctcacgtatgtgagtaatcttgggtggaatttctgaataagttaaaaaagacaaagctacatgttgcttttatcagggttgggggacccctgtgagtttctcttcgaggtcaggtcctgctgtgcgccctaagggtcagcatctttcccagacacggaggtgggaattggagggcctgggcctgggacctctgaatgcattcccgttacatcatttggatttctttatagactggagagtttacaacatcatcaaaacacatgtttttgtgattttccaacagccttgattcctgctaccatgtcctgttcccaggccaccactgagcacagcagacagatgccagcaagcatctgagctctcaaatgcacacagcatgtcccttctcgtgggcggggagctttggaaaatggaacactgggtgtgaaagacccagaaagggccctgtgaggctgcagagaaggggtgagggtgaggccagcctgcccagccagaccgtaactgtggagactccgtgagtttccagagtcgtgattagcatgaagaagcccctggggcccagcacagccatgatgaccagcacagtccgctgcatcagccaccgagggcctgggccctgtggaactcgccggggtagtgctcatgatcctgcttctcagtgtatctggactaggaaaccccatggtggtcaggacatccaggggagctgacggtctgtggccacatcactctccccttcaggcccaccaggctgaaagggcaaattccaaccctccttcagaaagggagttctccccgagtccttgagatccactgctctcttggggctaaactgtgttaacgaaaaattcagatgttgaagtctcaacccccagtacctctgaatgtgactgtatttgaagatagagtctttaaagacatgactgagttaaaatgaaatcattaggatgggccctaatccagtatgactggtgtctgtgtaagaagaggagacaaggacacagacactcagagggaggaccatgtgaggacatggcagaaggcggcgtctgcaaggcagggagagaggcctcaggagaacccagccctgccgacaccctgatcttggacttctagccctgtgggaactatatgggaaaccgtgggaaaacgactttctgtagttaagccccctagtctgtgattctttgtttctgaagctcaagccgactaagacagactctccagagccctggccaatgcgggcctctctgctgggtgaggaactaagcttagcgtgcctcatgaaggggttcaggggtgtccctgaggcctgtgcccattgcctgctctgtcttccccctggagagggcccttcagctctgtctgccctgggcatctcaatcccaccctggcttcccatccccacagggtgaactgcttgaaatgcagatgtgctcactgagaaagaggggcttgagccaggtttccaggcaatcctcacttgactgagccccagacggcagcactttgggccccatcccccaggcacggcctattcccctggggctgcacagaggctgtggggctgttacctggagctgaccttcggtgccatacagcccttttctctctggcctgagcattagccctctccccaaggcggtcctgcctcctacccccagaggggtgtgcttccctttaatttcctgcttcttccgtgaggatctggaagccaccttgcctctgggtgggacctgaactacacacctatagctggagatgctgccatggagcggagaaggaaggaggtgagctaagagaaggggtgggtgacaattctcttgacaccaactggggacccacaattcaattcatttctaacacaactgcctggagctagcacagaccccacaagctagggactctgccctgcaagactgcacccacttcaagatgccagccacaaatctcaggggccccaggccacctgcacttctgcctggcagagtacacatttgggggctcccacagaccgcccccttgataatttgctagaacaactcacaaaactcagaaaagagctgtccctactattacagtttatgataaaggctacagatagatggccacatgaagaggtccttggggccagatctggggcagggcccatgccctccgggctccccttccagcacacccatgtgtttcagcatcagaaagctccctgagccgcccgttccaggggctttgttggggtttcattacacagacataatggatgcaatcgctggccatgtgacggaacgcaatcttcagcccctgtgcctccctggaggtcagaggtgggcagggccgaaagcatccgtcctgtaatcaagtgcttgggctctctgatgcccttccctgccttatcccactcaggtgtggagaactctggtgagggccctcctctgggatacagaccactggcttctctcagcattttcatgtggcagaaagtgggtaagaaatattctgggggtcccttttataaggcactaaacccattccagcgggctccaccttcatgacctaaatcacctcccaaaggccccaatcctaatcccattaccctagggattaagatttcggcatacgaatttggggggacataaacattccatccattttctctcccctctctcctgagtgaccccatagggttactgggtgagggtaccactctcggtctgcaggccccactcctcctcccactgccgaaggtgtctagacccaaaggaggagaccctgccccgagtcatgctgctcccatactgccaccaggctgctgggatgctgggtggggggctgcagaggcaggtgggggccccgagagtggtgttagggcaccctgcccgatcttctaagtgacaggagagtggggcaggggtggcgcccatgaagaaaggctgttttgctgtccacgtggagagtcatacaggggatcacagtgtacagccttgggaaagctctcactaaatagtccttgaatggaactgggggggcctgaagcaggtgggttaaggggagcctccatgtgtctgagacctaagagcaggactaacttggtgaccagccggctgggtaggcagagcaagggcttcaggcttctgtctgggctgtgagagaccttgtggatgcagggtaggggggcaggaaagagtgtggagtggcagcttcattgcagacgtgctgaagatgaggacacgggagcctgggcaggggtagccatcagacatgaggacacctatgtctgaaactcagaagtcagggcaagaggcacagatttggggctagccatgccatggctgctggggagggcatgctggggctgtgatggagaagtctcctgtacagccctgtccctgacctcccacccctggctctctccctctccccagggcacagcttcccaggaaagaaaagccaatcccatgaaacattggtggtgcaagcctggcagcatctgtaacgctctcactgtgctgttccttgttgggactaagacagccgcaccagcaggcttctccaaggactgggcgaggctgccctgtgaagcacatggcccacaggtccgtgcacccctctgccacgccctggctggggtgggcactggttatcccttccccattggcctcaggatccgggttgcctggcttgtggagacttgtgccatgctcttctgattagccaactgtggaggcttccagaagtgcagggcgacaagcctgtcccactgggccccatcaaaccccccaagtgcttcccttcccactccaatacctctgcatctgaagctccatctgaggctgggaggctcctggcttcttcctagggctctggcatgcctcaccttggcagaacaccctcaaaatgtgaacacaagtgtgttggggtactgacgcagtcgatggggagaacctggcaggtgtggcatcaggctggcagcttctgaccagccccatgacccctgggtggccaccattcccttctctgcaaagaaagaggccatgagtgaccccctcctctggtggggtgaagcttcgaggagatgggacccttgtctgcctggcgcccagcttccactggcaccagtgggcattcagtgcaggaatcccctctgccctccccctccccacccctcctatccaagttgacatcctcactccggtccctgtggggtactcagaaggaaggcccaaggctgggcagagggctcactggatagcccaggagcccaactccccactttctccacccaccaacaccttgtgggcgagcgccccccagagcccaagggcccagggcagcagcccgtcctggaaactgctgtgaggcctggttgtgcactcaggggcagtggccgggctcctggcttccggcagagtcccgctgggaactccaagaagggaatggtgagtgggaggccctgaccttcttcatgtgtgtggatggaggcagctggaccccatgaggagctcaggtcacaggggctgggccctgggagtgaggggtcagggaggccagagccagtatgtgctggttgcaggtccaatcctgtcaaatcctcaccttcttcacgggaggggaggcggtcactctcatgaaccctattttacagaagatgaaacaggctcgaggagggttagtaccctaggctcacacagctgggggcagagctgggattaaaccaggttggatggggccagggaccctgagtgaatgcaccacccacgctgccctgcagaaccatgtggagatgggcacagtgaccggaggtggccttgggggtcgatgacatttgcaggcaatagtgtagctctggctctctgtagtatttcctgcagggaggcagagggcagatggggtctctgcctcatgatcctgcagggaatctgccgtcagcgctggagcacctgtgggcacttgatcctatccagctgtagcagttgtcatccccaggaggggccagagtggcagacagacctccgtgcccctcttcaggaagctaagggtgactggagctcacaggcctccacccagcctggactcctctctcccaggcttctgggagtcatcccagaggaggtggggcccagagtccatcctgtccaaagaccacagacttggattcctgcaagggccaggaaggatgagtaaagagctgaggatggggcctggtggaggctctggccacccaacaagcaccagcctctaagaaaggcacagccactgactgtgcatctgtgggctaccaggctacagcctcatgtggacagggtcggatgagcccctgttcacacaggtctgggctagcaaagtcctacagccaccctgccgcaccacacaggggagggagcaaaggcccccgactgcagaagccccaccccatctggcttcagtcttctctctgtctctggtcctgaggccctcacacgttccctgctctgttcccaacacaccctcctccaccagactgcctctgagagcagggcacaggcagcaggctatgcaagtgagaggctgtggagttaggcctggctcgctccacctccctgctgtgtgaccctgggcaggtgcttaacctctctgagcttcagtgttgtcacttgacaggtggttgtgaagatccaaagcaataatgtgtgtcaagtgctttgcatgcagcagatgaagccttcctttcctccctgaaattaacaagtgcagtgctgggaagtgggagtcaggcataatattaagtccatgctcaaataggttgtgggtctgatggcagaggtttccagctggggctcatctgttagccatgaacttctgacccagaacagaggaggagacacaggttcagcagctgagcgtgtgagttggggagtcaggggatcctgcttcccagtacctgcctctggcagggtcctgattgccgcgcaggtgggcaacgccacctagtgggcatgcatagtgccatgactcagggtattgattgtcctcacacacgcgcacatacacatgcacagagctgtgaacacacacctcaggcccctacccacaccttcacccgcacacaaacgtcttctagcttcttaccccttggatcctatcttggagctgagcatcagcagccataaaaccatgcatccttcctctttccaaaagccaatttggggattgtgtgaggacagccaggtagtctgaaatggaaagggggtgaggtcacatttgctaagggcatgatagtgcatgccaggctccaagccatgagggaggtgtcaccgtagcactgaaaggttaagagcttgcccaagcccacccagagaacacaagactgcaagccccaggctgtgcagctgtacggcctggttcctacaagctccacaaactattccttcataaaaaagggtttttctggatcctttaacttccttcttgaactagattttatttgaaatggaatcaacttgactcataattctatttagggtcccgagatgattttctaagtgacagcagaacctgcattctcagcagccattgtctaacctatgctgtcctcctcctccttctcctcccagcaacggtgtgtgtgtgtgactgtgtggtttgtgtgtgcacaaatgtgtgtgtgtggttgtgtgtgtatatgtggtgtgtgtggtgatgtatggtgtgattgtgtgtggtgatgtatggtgtgatgtgtgtgtgtggtgtgtagtgtgtgtggtgtgtgtgatgtgtgtggtatagtgtgtggtatagtgtgtgtggtgtgtgtgtgtggagtgtggagtacttgtggaatgaatgtgtggtgtgtgtttgtggtatatgtgcggtgtgtgtggtgtggtgtgcatgtgtggtgtgtgtaatatgtggtgtttgtggtgtggagtgtgtgtggtgtgtggagtgtgtggagtgtgaagtgtgcatggtgtgtatggcatgatgtgtatgtgtgcatggtgtgtatggcatggtgtgtacatgtacatggtatgtgtgatgtgtggtgagatgtgtgtgttatatgtggtgtgccgtgcatgtgtgagtgtgtgtaatgtgtgatgtgtgtggtgtgatgtgtgtatgcggactgtgggtagtgtgtggtgtgcatgtgtgtggtgtgtgtgatgtatgtgtgtgttgtggtgtgcatgtgtgtggtgggtgtggtgggtgtaatgtgtggtgtgtgtggcaagtatgtggtgtgtgtgtggtgtggtgtatgtgatgtgtgtgtaatgtgtggtatgtgtggtgtgtggtatgcatgtgtgtggcgtgcatgtggtgtgtgtgtggtgggtgtggagtgtgtggtgtatgtgtgtggtgtgctgtgcatgcctggtgtgtgtaatgtgtggtgtgtgatgtgtgtggtgcatgtcatgtgttgtttggagtatgtggtgtgttggtggagtgtgtggtgtggggtgtgtggagtgtatggtgtgtatgtgtgtggtgtgctgtacatggtggtgtgtgtaatgtgtggtgtgtggtgtgtaatgtgtggtgtgtgtggtatgagtgtgtttgtggtgagtggggttcgcggcaccaacaggcgctcagagtgtggttaaacccctgctctgcaccagatgtcctgggtgtgttcctgtggaacccgtgcctggactgcaggctgctcctggtgccttgtttctaatgaacagaacaaggcagaagtcatcggccaccacttccaagattagattacaaaaaaaaaacctcgggttctgccctgggtgcctcctgcctgctcccttgcctgtttcagggaaagccggtggccaggctgtggcctggagaggaccacgcagcagagaactgagcctggcctcagccaacagtcagcaagtgatctgccagcaactgcctgagtgtgcttggaagcagagcctccgagtgaagagagcgtgtgggacgccctgaggcagaagacccagcgaagccaccccaatccctgccccataggaaccgtgcgaggataactgttgttggaagccaccaaagggagggcagtttgtcacaccgccacagagaactaactcaatggaccttttctgtccccttctgagccccacactccctgctataaagtagggattgggtcacaggtcatgcttgcttaacacggtgcttgggaccaaagagagactcaacaaaagttccctttttcctgtccacactcagaggcaggcttggatcctgctcacccagcctcatgtgatgaaaaactccaagtcaggctccgtcccacagctggggtctgacaaacagcacccccttgccagccacggcagctggagaaggaggtcgccagcagcagggctggagagcagatctgatggcatcagctcgggcttgctccgtccatgccgggctggagtgtggccatcactcccagccacagaagctcgttgatctctgacctccctggtgggaacaggcccttctccaggacaggccagggcacctgcactcagacagtctgcgggtgctccctaggccagggctgacagccccgatggaaagctgatgccctgcctttggcacagtgagtccaggaagaggcacctagccaccacccacatctatgggagacacacctagccagctcctgattccctagcctcactccaggcacctcctaacactccttccatcttcctaaggggcaagaggcagcctcccaccccaacaacgctggctgctgcccaggctagcccagtgagctccatctgcagtcccatggcgtggatcccaggaccctgactcctgggagtgggccctgggaggagtttcagagctgctgtctcccaggggaggctggccaagcccctcttctcctgctctccctcccgtcaggcacagcagccccctgctctgggaaagtacaaagacctcacctctgagacccctccaccttcgaagctctaaaaccaggattctcgcatgagccaccctaacagcaaccctgataagatgttcttcctactttctagatgacgaaagtcagactctaaggctcaagagtttttggcaaggtcacacagcaagggtggcagtcttaaacgtggccccagaatcccttgactttccttccactgaggggtggggtttatgccctgtctttgagcctaggctctgtggctgcttggccaaagaaacactgtggacatgatgctgggccagtttctgggctcaggctgtaagaaacctgggttctcttggaacccaatcatccttctccgagggtgcccaagtggcccaaggagaagaacctggcttggccccctgctggcagccatgcggtgtgccatcttgaaagcggaccctccaccccaccttgagttgcccaggtgatgccacggggaaccatccccatgaagcccgacccacactacaatgtcatgagctaaataaatgtgtttttctaaaccgctaggtttcagggtaattttaagtaactgatacagcaagaagtgatgaacacagttcagatgatctccaagtccacagtctttttgattcccaaccatggctgcctccctgattctcactgtattagtctgaagagcttattaggggaggaacagaggccttgaaaagacccccaaactgaaatccccttccccccagggacagccccctccaggaaattcctttcagggctgtcctcgctgcatttcatctctagccctgcggcaggggtagaattcttagatgacccctaatgacttttgtcttttttataattttcctcgagtgagtaaatgtgagtatgaaaatctatcactctcaagattatgttacttatttcgtgcaaagactttgcaaatgttatgaaggttactagtcagtcagttggccttaaggagatattttctgcttgggtctaacctaatcacaggagacctttaagagtagaacattttttttctggtggtgggagatgaggtagtcagagagatttgatgcttaaaggggcttgtacactagggaggttctcctctcctgagacggaggggccatggggccaggtcctgagaggagcctctaggagctggggtggtccttagatatcagccagcaagaaagtgaggacctcagtccaacaaccacaaggacatgaattctgcccacaatctgaatgagcttggaaacaatttttcccccaaattgtccagaaaagaatgcagtcctaccaacaactcaatttcacttgtgggattctgggtggacaacccagttgagcccaccgggacctctgacttacagaaccatgagataaatgagttaagttgctaactttgtaatttgttacataggaataacaaaattaatatgatcccgttctttttgtttccagactcttccttctccaaaagtgtccttcctttttttcattgcagaccttgtaaatggggtgacatgtagatctttaagccgtggctggagcgtgggtctacagccttggccaaggcccctgggccagaccttgggagtagtgtttccacccatagctgagggctgagtgtgggcccacagtggaatgcctgagcgtgcactagctgggcctccatggcctggcagagccttcctgggctggaccggctgagtttctgagtccaggggatgccgccaatgatcaggctcccagacttcctgttagggtgactaagcccagccttaattaggtggactctgatgatctgttctctctcaatttcctcatttctaggacaataatggttctctgttcataccagaatttcctcctaaagaaccagccccagactcttcacaccatttattcagtcttctccctgtgtaaccccagcctttcccatctctttccttttctgaaacccagccacactcttacagcgcacgcttacactgctgtacaggtggggctgagtgtgcctgacgccccttcacctcctctcctcaccccagttcttggccacactctagaacgcagataacacaggagttcccatgtccatctttgaaatgagaagcctgaggcccagagccctcagcacggaatggaaggctttgaatgcaaacctagagggttcctagttactttatgtctctgcagttactttccaggtttttaaggacagtgatctttgtcttctatcaccactgaagttatccccttcagaaagaagcactggcctagatatgcaacagattgttaaaaaaaaaaactgtctgataattgcaaggttgtgtatttacttatcatatcaagaagaaacgtgtggttttgactctccatttccttactaatcatcttatctgtgctacagccccaccacattatctgtgtccactccacggtggtatgttcaccacatcactggaaaataatgccactcactgacagcacacccccaccaagctccatcttctcagaggatgagggcccagactctcaacaccctcttctctctgccccctgccattgtctccagaatgggagacgacgccaacctccatgctctgactctgctgaaaccctgctcccaggccctctctggtggcctctgactccactcttctcagccacacacagaaacatactcatcttgggtttcttcatccctcaagaatcaaaccagctcccaggccaagccctctgacattgccgtcattggccacaatctgcctccccttccacctctccccaggcctggttcacctgctttttatttccataaagaacaccccattcttttatcctgcaagtccctcctgaaaccattttcagctctatcctcacacacagaccaaacccctgcagagtccccctttctatggctgccttgtcaggaaccaaccatggataaggcaccacctgccttcctctatctcctagccagtgcgacatggaggggaagctgtgcaactgtgtgccttggctccttgacaagccaggcaacctccatgagccccccaggctgatgcacagcccagctcttcatcccttgctagcatccaacagctgttcccaatctccttctttttccccagtccacaaacccacccccacgtcccaaactcgtaccagatgaattcactttataatttattgagaatttcatcctataatgacattctcaccttctctccccttctcctgagaatgtctcttatcttaccccagtgtgtctttttctgagaaatacccttcctctttttgaaacaaacatttccctctggactctaaatctctcagcttcctgattccttcctgacctccttccatttttctgtcttctaacttcttaaatttttattttttagctgtattgagatagaattgatatacagaaaattgcacacatttcatgtatacctcttcatgagtttggacatatgcacacaccatcaccacaactaaggaactaaacatattcatcacctccaaaaatttgtgtacttttttgtaagtcactttttttgtaagaacacttaacatgaactctgtcctcttaatgtattttaaaatgcacaatgctgtattgttaaccataggtactatgctgtacagcagatctccagaacttactcatcttgcataacagaaactttataccttgaaaaacaattccccatttcttccccaccgccagcccctagcagctgccattctactgtttctatgagtttgactatcttagatgccttatgtaagtgacatcatgcagtatttgtccttctgtgactggcttattttacttagtatgtcttctaggcttatcctttcttttgcaaatggcagggttttcttctttttaaaggctgaacaatattccattgtgtatatgcatggcagtttcttcatgcatccattgatggacacaggttgatttcatatcttggctattgtgaatagtgctgcaataaatgtgggagtgcagatatctctttgatataccaatttcttttcttttgggtagatacccaactgtggcatgtctgggtcatacagtactatttttagttttttgaggaactgccatgatgttttccataatgactgtagtaacttacattcccaccaacagtgtaagaatgttcccctttcttcacatctatgcaagcatgctattttttgtcttcttgataacagctattttaactgtggctagatgatattgcattattttgatttgcatttctctgatgattagtgacgtttagcatttttttcatatatctgttggccatttgtatgtcttcttttgagaaatgtctattcagatatttttctcattggattattattattattatcattattattattagccattgagtggtttgagttccttacctattctggttattaatctcttatcagatggatattttgcaaatattttctctcattctgtaggttggttgtctctttgctttgttaattgtttcctttgctgtgtataatttttttagcttgatgtgatcccatttgtccatttttgcttaggtttcctccacttttaaggtattacctaggaacaatctttgcccataccaatgtcctgaagcattttgaactgggacacttttgaaagtgaaggaggtgtcattaataattacgcaggtcaacaggcatcaagtggactgtcctgatcatcctagccccaggcttgccataaggatatttgggatttgtttgaatcgggtgtggtaagacatgcagggattaaaatgactgtcatgaaggaagaggcctccgcacaggtccctagaaacaggaggcgtggtgccccagtcagagcccaacagggaagcactgggtttagtccggggtcaaggagagtgggaatctatgggcaagagcctttattgaggtttctgtgaaaagcaacaggcaaggcaaggtaaacaggcctaagatgagctaatttgaataataggagagggtctggggcacaggggctgcccaggtgtctggcacctggccctgggtgattagggcaggtgagtagtgatcatgagtgagagccccctggagggggtcactcagggtgtaagctctggactggttggtctgtgtcagaaaagcatgcgcttgggtgacttattcactgtccttaggaattggcaacgctgggaggggcagcaaggccccaaactgtcagagcagcagaatacagaaaataaaagggatggctaatatagggactatcagagtcacccaacaggctttttcataaagtccatgctctcttcccacccccgagagttaagtccatgctcccttcccaccccctcccccaggtaagaatgactgcctgagtgagccagtgctacccatgtacacgtgcacacaccaggtgcgtgtggaaagggagagattgggagccagggctttgcctgctgcctccccctgcacccccgacttatactgacttgacacatctaatgcctcaaatctaagtttgtgtccttcgcctgctggactggatcccaccgcctgcctggtgccacagtgactcctattttctcgttcacctggaatgccttccccctccacatgtcgaagacccagctgtctcaaggccctgctacaaggctgtttcctggaaattcagcttagggctctctccctgcctgagtcccagccgcagtttacactccctcccagcgccccagcctgccttccgccatgtccacctctcctatcagtgtgcgcttcctaagcagctcctctggggcagagagaggtgtagacactcttagaatgaacaatgctgcccacctccagcgtaaggcatggtgccgatgtgccagtgccttactccctggcagcatagtaaatgggagcagaagcctctgggaaacacgctgtcttagcctagtgtttcccatagtaggttacagggcatgtgctcttcctggggtttgctgaactgcaaaacttctcacagcttagatactgaggagcctgtgatgaagagattctccttagggcattgaaaacctttttttttcttttcttttttttttttttgtaatttatgtacttgccctcttttttctgagactcatgggactggtggtcttgaaaagcataaatgtctaagaaaggtgctttcaggagactgtagggccccgcttaagcaagtggctcctcccgcagactgcaggtcatgttggctggactatcacctattttactgatgatcctaaacctctgattaaggtgacctttgcctggtgaagctaatatgtcccatctgctccttctctttggtcccccaagggacataaactaagccagcccatccccttgtccttggctccagtcaagctaatcagctttcagtcccctgaattcaccacgcttcttctcacctctgtgcctttctcacactgcctgcttcaaccgcaaatctctctctctcatatacatcacctaatatatatatgaccatatatacagacataaatataataaacacatatgtacatatgtatgaagttggacatgcatgtgtatatgctaggctagaaagatggtagatacataatagatgatatagatgatagatggtggatagatagtagatagatcaatagatagataatagagagataataggtagattatagatgatagatatagatgatagattagatagatgatagatagatagatagatagatagatagatagatagatagatagatagatgataggagagattgcttattaggctgccccttttacttaggacatatctagaaatattcactaaatgaagaaaggtaaattaaactagaaagtaagtgaatggatggatggatgggtggaaggatgcatggatggaagtagaatttgtattacacatattggagaattttaatctgataataaacagaaggtgtggcttgacaaggactccttccttgccagactttagtcagtctgctttgagccctcttcttgactaggccgtggcctgttgaactcagtttacggagacttccccaacccttgatgtctaattaagttcctcttagtgattttccacccactgacacctgactatacccctgcaccttggctataaatccttagctgtctttgctgtatgcagagttgaactcagttctatacttgtctctctcccctactgcaaaaacctttcttgccatttttaacaactgtccagtgcaatttcttcttgacaggctgtgaatgtgtacatgtatagacccattctgggtttcacttggctgctttggacaaatcttaggcattgtaggttgtcaccagcacatttgtaacatgggtgtactgcctactgggctctctgaggaaacccttccagaaagggtcagaaggcaattcttaaatgtaatgggtgctttagaagtcagcctagatttgaagtggtgtatcagcactgaagaaacactgtgttctccttcagcacgctggaagaacagcaacgtgttactcattcaagtttgtcctcttggcccttgggctcccagaataaaagatggcttctctagagtcagaagggcaagagaactgtggggaaggaagtgaacgctggctcaactgctagtgcctgcctggttcatgctaagcactctgtccgtgtggcctcacgcaatcttgccagcaacctgcttgggcagatatcatcactgtttcacacctgggtgctcatccatgtggcttctcttcacctggcctcttggcattagtctagccctagcttctttatagcatgatggtggcttccccagggtagcagaagctgctggtcttcttaagggccagaatcaggactggcttaaaaatcatcactttgtctacattttattggtcagggagtgtcaaagctttgcccccaattcaaggggcaggaaaagactccacttcttgaaagtagagcagtgttcctgaatagggaggggaggaattgatggagaccatctactgcctgccctgacccgggacggggacctggtagggattctgctcactgaggccaggaagcaggtattggacacctgtggcatcatggaccggaagtgcattatacctacctgggccaggtacaggtgctgacggactcagaaacagatgtagggattagtggaatccaggactaacctacactcgcttacagtaagcctgcatgtcacaaatccgaggtggccctgtagagggagccacggcctttttctgctagtttgggctagccctgggccacagcagccagcccatcggtccagggggagtctagaatgtgcagcgaggccctccgggtgcttgctggccaagctgcctgggctgtgtggctgtatcacagtcctgaccgcaccctcccagccttcccagaacagagcttccaaggcgaaaacacctcctggctgttctccttccccaaatggctatgttttatgatgtgctaagtttgggggggaaaaaagaaaattcctccagctgtggtgtaatcccatctgaaggcattccagggatttgatttataatctctgggcatgagccgcatgctgggctctgtgagaggggcgcctgtccggggcgctgcagggccagggccgttgaggccctccgggtggagctgcctcctttgtgggttcccagtttccagcatgctggagctgtctccaagcccaagttgtgcatggaacaggcatgcagctaatattcagaatcaggatgagctcactctgctaccaacttgcataatatttatttattcactcatttaacaaagtttctggggactagaaaataccttaggtactgataatacaaaatgaatatggcaaagattgaaatacgtttgaaccaaggttaatatcagaggtaggtattgaaagtttcaacccaacaatcagcttgtaaaacagcggtctgttttctttccctttttttttttttttttcaagaggggttgaattatttttgtgagggtgctggtaagaggaagctctacatgaattattggagaataacagttctgaaaggagatgtggctgttctaagcccagcctggtgctggtctccccagtgtctttctctcgagaaagaaacaaatgaaagttgatctcagcaaccaggacccatctgggtacccacacctttccttcccagcagccctgcagggttgaggcttgttctcacagcctggaacacaagaatagcatgtgttccagatggagcagaatgattctggcctaggaaagacattataccgaatgggtttcagattcttattggtatctgggaaaggacggacagccacttctacttaaagaaatgcccacaatcccacttcccatcatgggcagaacatgcacatgaactgcaccccacagaggaccctgtgtacagggtggtgcaaggccaacataaaatcaagtcaggccaaagaggaaaagtgtctttgcccaaccgcggtattgtgaagggagccttgcacagctgagtcactattttgattcaaagactgtctatttctttttgtcctccctttgtccctttgtttccttggttgaaattgtgctcggtgagtgaactgtccctggcctgctactagggtcagcagggcctgagtctcatgtcacctttgatcatcattggcagcttctccagctccctgagacagtcagggcagggggctttaaaatctttgagcaactgtatacatagagggctgaatcctagacacagctgacatatactatgacttatttcatttttaaccagtaagtcttgggtctatctgttattagcagaagcttctaagcaaaacaagaattccaaaattcaggaggattagcttgacagatttcccaaacaccttggacagcaacatgagttaaaatgtgacccccatcatcactatgcattcatcatgactagcttgcctctctcaaaaaatggcctgggagagaatgggccagaggtgctgttctatctgtcaaatgtgatctatgtaatcatcctagttggcactgcagaatgaaaactcaaatgtgtctcttctcattccatgaaaaaggaaagctcctgagggttctctgtgacaatacttatgctacttattcttggtcctgtggtggcactcagtttctctaaaagcgaaaggacattatggtggcctacttcacccaaatgctaggagatcacacagtgaaagtcaggtatttgcattcattcactccttagaaactatgtactgctggaaactgaggagcagagacatcccctgcccctacaggacagtgttggtgaggatggatttaaagacaacagagcagaatccgagttgccccctgccctgattcaacaccagctgtcaacatcagctggcagagaggaggaaaagtggcttccaaagacgaaaagaacaatcaaggaagccattcgaagatagtagaaaagaaagcaacagtcagctcaagaatacgcagtagatgaaaactacagcttccacacaggaagagctaaaggagagaggccctcaaaaaaaggttacaagaagagtttaaaagtgagttgaccattttaatgatattgattcttccaatcatgagcatggaatgttcttccatttgtttgcatcatctgtgatttctttcagcgtgtaattaattctccatgtagagatctttcacctccttggttagatgtattgctagatatttttgtggctgttgtcaataggattgtattcttgatttgactctcagattgaacattattggtgtatagaaatgctactgatttttgtaccttgattttgtctgttgaaactttacagaagttgtttaccatttctagaagccttctagtggggtctttaggggttttttggtttagaattatattatctcttatttctttttcttgcatgattgctctggctaggacttccaggactatgttgaagagaagttaatgggtatgggcatgaacagacacttcccaaaacaagacatacatgcaaccaaaaaacatatgagaaaatgctccacatcactaatcactagagaaatgcagccacaatgagataccatctcacaccaatcagaatggctattattaaaaagtcaaaaaataacatgctgatgaggctgtggagaaaagggcatgctcatacattattggcgggagtgtaattagttcagccactgtggaaagcagtttggatatttctcaaagaacttaatacagagctaccatttaacccagcaatcccattactgggtatatatccaaagaaaaataaattattctaccaaaaagacacatgcacttgtatgtgcatctcagcacaatttacaatagtgaagacatggaatcaacctgggttcccatcagtggtggactggataaagaaaatgtggtacatatacaccagggaatactacacagccatataaagagaacgaaatcatgtcctttgcagcaacatggatgcagctggatgccattatcttaaatgaattaatgcaggaacaaaataaaacaaatactgtatgctctcacttacaagtgggagctaaatattgggtactcatggacataaagatggaaacaataaacactgggaactcctacagtggggagagagggagggaggcaagagttcaaaaattacctattgagtactatgctgattacctgggtggtgggatcagtcatatgccaaacctcagcatcacgtaatatacccatgtaacaaacctgcacatgtatcccctgaatctaaaataaaagttgaaattttttaaaaaagagagaaatgacttagcatgtcaatgaaagactttatattaatgacaaactctagtggaatatatgtccattttcttcacttttacgtaataaaatttaaaactttcaaaaataaaagataaatgagtcgacaacggtgcttggggaaaacaattcttgtttgttaatactctccaacccagctcttttgccttccagctggctagtcattaaacagttaaatgaaacaataaagtgtgctcactccctctgtgtatgagaattatgtttccaacacaatagattcctccataacaacactgaatgttaagagaaagtaagtgaaacaatgtctacaagccctccaagtgagaaaaaaatgacacatgaattttatacagagccaaaatgtcacatacatataaagaacttcaattaattgaaagaatgccagaaatcaaggacagtagaacttgtgagcccatcttggaaaaccttttggaggatgaactgtcatcagccaagttatgcataatgaaatttctatatactagctaaagagacaaaacaaatttgtcattacattatgctctttggatatttaattcactcctccttatcctaatattcctaatttcataaccagaagctgaagtgatgtcactttatccatgtaagttcttctccaggctcttcaggtgctaatatgcttaaatctcttcaaatattttatagtgtttgtttttgtcgacaattggaatatgaccatgttcctgcctgtcctacttattatacgggtgtgtcaaaagggcaagtgtgtcacagggcaagtggcatagcaccaggagatacacacctgcacgaatgtccatgtatctgggtgtgggcaaccagagtgcacatgagaatgagaagggctacttctgtgactttcctgaaccaatagtcccaatagagccaggctagagcaaaaccacagcctccaaacccagaggtgcctcccccagcactgatttaggagcccccagcccatctccaagtgttgtgcggcactctgaagttcctcctcacccccttgaggcagctgctccgtgggtctctggactcctcaaactctgattcccctggcagaacaccctcctggctgcaggtgtggctcctgtcccagcctcaaagcaacaggttcctgtgctcccatcattacagcgaagagctgagggctcttttcttttaattgaatcccctgaggaacgccccccaacaacaggatatccccaggctatctgttcttatcatactcataatgtttggctttgtcatgccattcacccagcctcaacttaacacactttccctgaaggtctaaatccagacaaaaatatgagcaacccttctcaacacttggcctccctaacataattacaaaccccttattcatagtctttggctctgtccagagcttaggcagtctcttcatgcctggatgattctcccacacagtatgtgacctgagaagtcaggaatgatcattgtgctctaatgtcatagcaagtggcatgccacctagctctgggggtggcagtcggtgccagaggccctgtcattgtcttccctagaggccataagaactctcatggaaataagttgaccccacaggtatgccagcccagacatcctggtgaggccccagcatgccccagttctcaacggcaagcagctcgggaagtaccgaaaggacccaggcaccatttagttttgtaaggccattcagtaaagctcaggctcttggaaagccagcctctttgattcagtcctttgttgctactcgctttaatgtttacctcattttctgcttcatgcagccagaattactggtaaataagcccttcagcaaccgtagagtcttgtgctctgctggagatgtatatgcttggagaatgaaatactgtgaacatacatatttcagtttggactgtgaaatgccttctatacatctgatttgtaagagagatggttctgatcgctaacatctcagtggtgatcctgaggagaaaggcttgacagaattttaaaggtgctctatggagtataattaaccaaatccaccccccctccgtatctgaaaaagaattctggcagtgttaccagtgaggaagataggttcttttgcataaagggacgtttagttgtttccctggggttattatttccaagcctggctgtgtgatggactcagtttccccagttgcattccaatccattcttcagaccagtccaaaacagtacttaacttataggagagaaacagtgttttaccataaaatgtgcttctgttgtaagtttgctgtagctatgccctagcagattaaggtaattcccttctattccaagtttactaaaattttttatttttaaaatatagaatggatatcaaatttgattcgaattttttttctgcatctattgaggaatggctcttgggaacaatattttctgagctcttgcatgttgatttcaattttcaccctgtgcatcaaggtcagtttttctagacataacatattggctcataaaaatctttccttggacatcttattattccatcttcttttgtattaaagcattactcttaaaaatctgataatcatctaattttcttttcctcatattcttttgcgtaaatcctcccccctccccattttctttcttcaaactgcagcaattttacttaaaatttattaaaccttggtattggtcatactcatttgatggtttcaggtatgtactatgatacttcaacatataattttaaaaacaattatttcaggaaaattttctttaattattactctaaatatttcttgaattagtgaatttgttctgaacccttgctttggtttttcttctttaaactttctgttatctatctactagtcttctttacctatcattgatccttcttatgctcttaaatcctgttttctttctccattttgttttgaaattattcctcttaagctttctatttattgtaaagcatcagttatcaatttttttgtgttccttctagtttatagattttatttctaatttttgtttctaactctttcttgattttcatactgctttaaatttttctagttctgatttttgttattccatcctgttttatgcaattctcctattgtctttaagctcattttgaaatagtaggatatcgttttctgtgacttcccgagctgcttgccattgagaactgtgttttgagtgtatctttctggtgtaccttcattgtttgtaagggatgctattcagctcctcagtcttttttttttcttatggtaacttgtacgggatttgatcataatattttctagtgcttgtttccatgtgaatttggatttcctgaactaaacttgacttggacagacagctcttataagttcactgagcttgctttctgaggttttctggctctattctcctcaatcacttttataggatcttctcttttctttatcccattctctccattctctcctcaactttgattctaaggtttctcctcagtgtgactctgttctggaaaggagccctggctggtcaccttttagagcagataagagctacactgctctaaccccttcaggccctaccatgtactcctcgcacttttccactttgaaggtgaaattaaagggatacaaagaaatggaagaacattccatgctcatgggtaggaagaatcaatatcgtgaaaatggccatactgcccaaggtaatttatagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacgctacctgacttcaaactatgctacaaggctacagtaaccaaaacagcatggtactggtaccaaaacagagatatagatcaatggaacagaacagagccctcagaaataacgccacatatctacaactatctgatctttgacaaacctgagaaaaacaagcaatggggaaaggattccctatttaataaatggtgttgggaaaactggctagccatatgtggaaagctgaaactggatcccttccttacaccttatacaaaaattaattcaagatggattaaagacttaaacattagacctaaaaccataaaaaccctagaagaaaacctaggcattaccattcaggacataggcatgggcaaggacttcatgtctaaaacaccaaaagcaatggcaacaaaagacaaaattgacaaataggatctaattaaactaaagagcttctgcagagcaaaagaaactaccatcagagtgaacaggcaacctacaaaatgggagaaaatttttgcaacctactcatctgacaaagggctaatatccagaatctacaatgaactcaaacaaatttacaagaaaaaaacaaccccatcaaaaagtgggcaaaggacatgaacagacacttctcaaaagaagacatttatgcagccaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactattggtgggactgtaaactagttcaaccattgtggaagtcagtgtggcgattcctcagggatctagaactagaaataccatttgactcagccatcccattactgggtatatacccaaagtactataaatcatgctgctataaagacacatgcacatgtatgtttattgcagcactattcacaatagcaaagacttggaaccaacccaaatgtccaacaatgatagactggattaagaaaatgtggcacatatacaccatgggatagtatgcggccataaaaaatgatgagttcatgtcctttgtagggacatggatgaaattggaaatcatcattctcagtaaactatcgcaaggacaaaaaaccaaacaccgcatgttctcactcataggtgggaattgaacaatgagaacacatggacacaggaaggggaacatcacactctggggactgttgtggggtggggggaggggggagggatagcattaggagatatacctaatgctaaatgacgagttaatgggtgcagcacaccagcatggcacatgtatacatatgtaactaacctgcacattgtgcacatgtaccctaaaacataaagtataataataatgaaattaaaaaaaaaaaaaaagaaagtgagcaatgcccatccagtttcagacgccatcctcagcttagccccaccacacctcctagtaaatatctgttggatctttaggctgtgttcaggtctatcagttggtaaataaaacgggtccttcaccagagtttgagaagcattgctgaaggaatcagcagagggagagatgagtgttagaaggcttcatagaagagatagttcttaggccaggccctggagggcaatcagggttgaagtgaatgttgaagttcctcagtgctctgcccttggcctccatctcactttgtttgtggagcttatccattcccatgccctcaaacatcactttcaaggcaagcattcctccagacctgagttttcagctcaggaatcttttttaacatgaaacttgtagagacacttgcataggtataatgaattcagcatgaaccaaacaagtgcatgactttctccccaagttttgtcaatgaatctcaaaagttttgttgcgtttttattttcgttcagttccaaatattttgtaacttctaattttttctctgactcataagttatttagaagtatgctgtttaatttccaaatattttggaattttaaaaatatcttcacattattgatttctagttaattccataatcatactttatatagttacattcttctgaaatatagtgagactaatgacccaaaatacagtctcttttggtgaatgttctatgtccgcttgaaaagaatgtgtattctgctgtagtttagtgttctgtaagtatcagttaggtcaagcaggttggtagggttattcaaatcttttacgtcttattttctgtttacttgttctatcaattacttagagacaaatgctgaaacctcaaactctaattatggatttgcatatttttccagtttgatcttatatatccatttttgtttcatgtatttgaagctctgtatttgaaatgctatccttagcatacagtaaattcacaaatataaatgagtctgtaatgctcaactctattttgttccatttatctatctatatatccatgtgccagaatcagattgttttaattactgtgactttagataatactttgactatcgttaaggcaaaccttttccctttcctccagttaatttttctttctcaaaaatatcttagctcttttcatacatttactgttcatttagaatgtaagcatcatctgggcacgttcttgttaagtttaatcttaagtatttcacatattttataaaatatacattttatatatgcctgttgctcaaagatatttttcctgttgaagatacagaacaggggttggcaaaaattttctttaaagggccaggtggtaaaaattgtaggctttataagacatatgatctctgctgatactattcactcagtcatcgccataatacaaaagcagccacagacaatatgtaaacaaatgggcataaaactttatttacaaaaaaaggcaagaagtcagatatggcctgtgggccatagtttgctggttgtagataaagagacagactaatagatatagagaaagattaatttttacatagttatcttgtatcttaacttcataataagtttgctaatactatttttgagttgagtctattatttctatgtgaacaacgtatgaacaaaagatcattttcttctagctttccaatatttacagcaattattccacttttgtaatcttactgcattggctagataactctggagcaatactcagctactgtgctaacaggaggtattgttttgttaataggggggctctgtttttcacctacaaatttgatgttgctgttggtttctaaaaaatgttatcacgttcaagtttcagatacaatgcttgtattcaatcttttaagatcccttctaattcaaattgtttaattatgaagtaattaccagtttttgattgaggctatagacaaatgagtgttccagtgagcaatccatcacccccattgaataccaatgacttgtttttacttaatagagaccttctgaatcttcttgttcaattacatgaacctcaagacaacatagaagaaaacgaattcttccgaggaattagaaaaaaattaagtaggaaataaaagtattttgctttagactttttaaaggtgttttcctttgaggtttttcaataaaaataaatcactaaaataacttttgagtgctaaaggtaaatttagctgaaaattcaataatgttctaaggagattgggggtaaaaggtccaaaggaagataaattactaactctaatatggaagaaaaaaatctaagatgtttatttctgaaaagctttggtctaacatgtaagcctcaagaacatacaactttaaaaatatgtatttaaaattgaaagttaataaatatatatatgcttatatttaaatattttaaaacttcctttaaattagcattcatatactcacaaaggtgtcaatgaaaatttcatgttcacattgcaggcagaaattgattcattattgatataaaattatttcaatcagtcaaaagttttcactttggcattcaccttccaagaatgaagtgaaaacaaatgcaattagtatttccatattcactcctttaatttccctggaaaactaaaaattagtccagctgtaaaaatatgaggcacacattaaagaagagacatgtttaacatcaagcattgtggaatttttctttacaagacgatttcaaggcccagataaataaaaatacttcaggcaatacacagtaaatattttattttaataatagcatagaattcttctgaagaaaattgttatacattatagctattattttacagtaacagagagaaaataaaattagagatacaaatattaaaggccaattatcaaaatgaaattaacacagattattattcatatgaacaatgtaaacagaatcatctatttgatttaacatcaaatatatttttggcatataattatttttacaatgagaattattaattattcaaccaattcaaatatactcattcagccaaaagaacaaaataagcctcttagaaattcaagatttatagattgatattaaacattttctcaatacatagaatattctgatctccattgagttaaactgtacaaacactcatatctattgttttatagcttataattaggtatagcttgtcaccagaactccttgtccaaaatatcactattaattgtacgaggcaaagtcctataataaaattactgtaataatggccacatcttttcaaaaacagaatatggaagtttccattttcatgactatgaatctggttttccaaaattgggttcccaaatccagtttctaaatgtttcaacagaggtgagaaagtaaaggaaataaatgatttaatggaactctggaaaaaaaactatcatagatcttagtttgaaaaatacatcaaacatgagatataccatgaatgactcagaattatataataatgcctatatcaaactttattagttagctaaagggcaaagagtaagaggcaagttaaaggtaatacttgcttttaacaaagcagactaagtaatatgttaagtgttagggtgggataggaaagaactcaggcatggcaaaaatctcctcttgggctttctatataaacatctattttagttttggactgttcaccgagaggagctctccctatccatgaaatgcttcccagaccaacaggtcttggtctagcagctgtaggaaggcagcagtatgaaaatgtaggaaatggaagccaatttgtgtccaaagttagtccaccctaactggactctttttaaactgggttattcaaatgccagcaaaaagtacaggctctagctaaagaacatgaatagacatctgtcttaaaaatgcctggaagaggtcatgattattggccttatgttctcccagaataagaacttacaaagtcctggaaatcctcagctctctccagccacctttccaaataaaatcttaatgaatatattttaaatcctttattgggctctgtaatcccttcaaccaaatagccaagctgcaatcgttttatgtaacatctgtttcactggaaaatgtgggaagttattttgatattgtctagcaagatcaataagtaaacactgatcaccccaagccaaatgatattgcccttcagggagcttttagaaagaaaataaactgataaaccaagaaagcagattgtatgcatagcaaagcccttcagcacagtgcaaacatgttctttatgaggaggtgcaaacccacttggtaatttcaagtgagaggcaacagaagtctttcttaatccaaagtcagaagtttccgaagaacttcaagcacaatatcgtaacaaaagtgatactgctcctatatacatatatataaaaaacaacagaatgttaagtaattgaataacagaatccactttcagaaaacacatttgtaattttcagccacactggaaagttcctaaaaagagcaaacatttaactataaacacttaagaactttacgtgaatacatttttaaaactatgaggaagataaatgatcaaaatatagctcttggcctagaactagttaccttaaggcttaacataactgttttttttatcattatccatattctattaatctaccctcccaatgactactaacaaatctgtgacataaatgatgtctttttatgacgtcctgataaccttgacagtttagtggcaagtaaatatctcaaactgctatccagaaatgttttaaaaataactttagatgttacttaaatagcacggcattatggacaaggcatgtgtttggacacgaggagacctcaacttcaggcttggctcctccccttctatctgagtgaccccatggagcaggctttattgctctgaatttgaagtacttggtcaggaataccagagaatcagagcaaaactaatgtctacctcaaacagtaggaattcaatgagattatgtcaataaaagagcttttaagtggtaaaatgttatgcaatgttaatctttatattcattattcttattattatgtatgtggtgaaagcttaccttcgtttgaaccatgccagaacgttgttctctcatttgggccactatatccatgatgttgaactgtaataagatgacagtaattttgtatgatccacatgggggaaaaacacaaattcacagattgccaaaaagggtgaaagagatgtcaagatttaatcagaaagatctcattttcactcacaagaaaatgtgctatttttaacttagcccaatggataaggaagactattttaataggttttcaggagaaagcaggaagcaatcattcataataagaaatgctctccaaaataagtaataaatttgcccttgtgtgtccctgtttgttatccaaaggcagaacttaaagcagcactgtaattctggaaaggcacagaagactttctctggccccaacaatagcatatctgtttcttatatgaagatccctgtcaactcacacggaaactgggagcaacagtcgacccaacactagattccagactgtgtgtggacaccagtacagctgggtgtggtcattgagttggtgcaggcctacaaaggtctgttgctggtccacaatgagtcaagaaactgggagtaagtgctcagaaactcttatggcaatttgacactggcacagcactgagaagtgtgctcaactgaacaggatatagaccagctcaggtgttgctgaacttgcctggagagtcacatgtgggacaagctgagaatgagtcgtttcagcaagacattgtggacacatgtaaatgttgtcaactgtaaccccaaagcatataaaaatagaaaacaataagcattcctttattttcatagcttatcatttttataattaaaatttttaattaaccctttgaaaaaactttttgttttttagagacagggtcttgctctgttgtctcagctgctggagtacagcggtgtcatcatatttcactgcaatctcaaactacaatcctccctcctcaacctcctgagtagcaagaactataggtgcgttccaccatgcccagctaacttttttatttttatttttgtagagatggggtctccctatgttacccaggctggtttcaaactcctggcctaaagtgatcctcagccttggcctcctaaggtctgggattataggcgtcagccaccatatctgccataaaaaacattttattttataatacagatatacaggaagttgtacagggtggccctgtgtatctttcacccagtttcccagatggtgtcatcttgtttaacaagatataatatcaaaaccaggaaactgacattgggacaatccacaaagcttaattcagatttcaccagttttacatgcaactgttagtgagtgtgtgagagtgtgtatgtgtgcatgtgtgcatgcacagagctccatgcaattatatcatatgtgaagattcatgtaactataaccacagtccagatacagagctgttccaccacaagacttcctcctgctatccctatagagtcacactcatccaccccaatctctaacccttggaaaatagtaatctgttctccttctctatgcttttgctatttcaagaagaaatagcaaaattcactatatgaataaaattgcacaatagctaaccttttgtgattgacttttttcccacccagaataacttggagatccatccaagttgttggtgtaacaatagtttgcttccttttattgctaaataatattccatgatgtggatatgtgccactttatttaaccatcaatttgttgaaggacatctgggttgttctggtttttggctactgtgaatataatctgctatgaacatttacatacaggtttctgtatgaacataaattttgattaatctgggataaatgccccaagagtgctattgctgggttatatgtcaactttagttagttttgtttttgttttctttccaagaaactgctcaattgttttccgcagtggctggtaccagtctacattcccaatgtctcatacatatgggtaatgtatgagcaatacagtttctccaaatcttcacataattctccaaatcctcaccagcatttccaaatcttcatcagcatggggtgctgtcactatttttacataagcctttctgataggtgtgtaatgctactccatcctggttttaattagcatttccccaagggctaatgaagctgagcatcttttcacgtgcttgtcatctgtatgttctctttggtgaactgtctgttcatgtcttttacccatttctgtttttcttttttttttaactattgatttttgagggttccttataaattctagatccaaggcctttgttggatatgtgccctgcatatagttactctctagcttgtttttttttttttatcctcttcattgggtctttcacaaaacataaaattttagtttgctttccctctgagatcagtgatggcaacaacgcctgctctcaccactcttattcaatatagcacttgacattttagtacagcaataagaccagaaaataagtaggatgtatacagattgtatacagatcaaaaaggaagagacaaatctatatgcacatggcatgactgtctatgtagaacacactaaagaatctaaaaaaaaaaaaacctacaaaacctctaagagctaataagtaatttcaacaagatcacagggtacaagatcaacaaatgaaaatcaattaaatttctacgtactagcaatgaatatgtggaaactgaaagtacaaacacaataccatttacaattgctccaaagaaaatgaatagggtaaatttaacaaaacatatacaagatctatacactgaaaatgacaaaatgctgatgcaagaattcaaagaagacctaaataaatacacttaccatgttcatggattggaagattcaatacagtaaagatatcagctctctccaattaaactacagatttaaagtaatttccatccaaatcccagcaagttttgtgtagatgtagccaaactaattctaaaatttattagagaaagcacagaccctaggatagctcaaacaattttgaaaaaggagaataacgtgggaggaatcattctatctgatgttaaagcttactatatcactacaataatccaaagggtggtaccggcagaaggatagacacactaatcaatagaacagaatacggaaccagaaataggcccatacaaatatgcccaataatttttgacaaaggtacaacaataattcaatagaggaataacagaattttcaataaatgatattgaaacaactagccatcaataggccaaaaaatgaatcttcacctaaatttaataatttattaactcaaaatggactatggacttaaatgtcaaatatgaacttacagaattttcataaaagaacacaaaaaaattattcaggccctcagctaagtgatgagctgttagacttgatatcaaaacatgatccataaaaggaaaaactaataaaatacaatctcatcagaattaaaaactgtaacttctttaaaagcatttttttaattataatttaagattaggcaaattatggaaatacatttgaattactaatttttaatcagtttactgactataaaacaagcatgactggactgttcagttaagaaaagacacagctttccaaatgtggctgtagtggttaaccaaataatgaagatggaagtgactgcaatgaaatgaagacaaagagttatataattttcacttggagttatgattcctcatatattgagttttatagtcattattgattgtgaagctctaaaactacacttgtgttatttccaaagatgtactggttaacaaagcaaaggaaccattaagacttatttgtaatttacataaaaaataattaattcaaagataaaataattatcttaaagagaattagattaaaaagacaagagaggacttctggttccaaaataacagtgtagaagcaagctggcttcacttctttacaaagaaaaccaaaaccaaatatacagcactgaaattatcaccaacaatatcccagaaatcaaatacgaggagaagacagttcctggatccacagagatgggaaaaaaactctaagtaggcagtaagagaattgggtttccacatctgcaatgcccattcctccaatttgcccagcaccaagagtgcaaaaaatctccacctgattcatgatttctataccagaaaaggtgacatccaggtttcccaccatctgggttacctggcaggaaacctgtccctacctcaacccacaggaagcactacatgtgcctgaagaaagaaatatcctgagaacagtcagaaacaaacaggtgaggtgggactaccatccccagccctggaaactctggtctgtaactcagctaaaggagatgccaaaccagagtggttgtttagtagcaccacattgcagaagatacattgcacaggacccctgggcatgaatctctagccacctttcccacactgccatgatatctcctttgagactttccctaattggaatgagcagctctcttattgtttactggagccaaggcaaacttggtcgtaaggtgacatctagtgccaaaaagaaggcagcaacttagcccctcaccaaaaaaaaaaaaaaaaaaaaagaaaaaaaaaattcgacaggtaaattacatagaatctataaccaaatacattcaataaaaaacaaaaataagccagacagagaacactggaataaataactaatccttcattcaaagacatcaatacaagatatatatttcttgcacatccagaagaaactgcagtcaacacaaaaccatgacctccccaaatggataaagcaaggaaccagtgactgaccctcatgagatagccatataagagctccctgatcaaaaattcaaactagtattaatagctttgaggaaactcagagatctccaaggtaacagaacaccaattcaaaaatttattagacaaacttaacaaagagattgaaataatttaaaaatcaaatagaaatcttggagctgagaaatatattagctgaactgaaaaattcattacagcctcacaatagcagaatgaatcaagcagaggaaagaatcagtgagcttgaaaaccggctacttgaaaatgcagtcataggtggaaaaagaataaaaaagaatgaagatcatcaccaaatatagacaattacctcaaaagaccaaatccaaaaattactggtgttcaagagggagttgaacaagagcaaggggtaggaagcttattcaaagaaataataacaaaactttccaaaatgcaacagatataaatattcaggtataagagcatcagggccgggcgcggtggctcacgcttgtaatcccagcactttgggaggccgaggcgggcggatcacgaggtcaggagatcgagaccatcctggctaacacggtgaaaccccgtctctactaaaaaaatacaaaaaaattagccgggcgtgatggcgggcgcctgtagtcccagctacttgggaggctgaggcaggagaatggcgtgaacctgggaggcggcggagcttgcagtgagccgagattgcgccactgcactcccgcctgggccacagagcgagactccgtctcaaaaaaaaaaaaaaaaaaaaaaaaaagagcatcagagaacaccaaacatattcaacccaaataaggctacaccaaagcataaaataataaaactctcaaagctcaaggatagaggatcctaaaaagtagcaggagaaaagaagtaattaacatataaaagagctccaattcatctgacaattgactctcaacagaaatcatataggccaggaggaagtgggataaattttcaaagtgttgaaagaaaaaaaaaacctgttatccaagaacactatattcagcaaaggtacttttaaatatgaaggagtgataaagtatttttcagataaacaaaatctgaggattcaacagcagcagacctgacttacaagaaatgctaaagcgagttcttcagaaggaaaataaaaaaatacaaaaaaccacatacacattcaaaaagaaaacttttcaaggcataaaatccactggtaacattaacaacatggacaaaaccagaatactctattattgtaatgatggtgtgcaatccatgcctaactctggtatgaagctgaaagataaactcataaaaagccgtaatagctacagcaacctattaagagaaaggtaatataaaaatacacaaatttagataataagcagttgaaatgtggtggggatggagttaaagcatagagtatttttttaaaattttttctttgtttctattctttactttgtgatctaagataagttgtcacttctttaaaatagcttattgagatccactcaaggcaaaaagaactgggaagtccccacagctgtctgctgggcagaaaaccctaggctatgggtgccacatcagccatacacccacggcaacaccgccctgcctggagatctcacacccttgacctactgcatcaacaaaccatctgtaggtctactgcacaattagctctgactcccaagcacagaggatcagcaggcctccagtgtgctgtggatctcctggtgacctaatctttggctcgagctgccccaagggaggagagagcacaggctgccagggttccccttggggttaaagagatgtgggcatggtgccagtgactggagggggctcccctaaggcctggaaatggacctggcaggggatcatcgctaccccttcccaccacccccactgctgcaaatgtgctggaatacaaaagagccatgtgactgagagtctatttgccggccattattctcaagcaccatctactggattgaagcctaaattacaacaccccaaactcttccagtatacactgcctgtgaaatccagtgccagaatctagccacaagtattaataaatatcccatacagagtgttggccctctgaaagcacccagaaataaagccaactgactatactcagcttatgctacagtcaaacccacaagggatacaaagaatataaaaacaaaaagcctcatcgaaatgatagcaaattcaacaagataaaagaacacgtgccctctcagaagagaaagatttaatgcaagaactttggcaattcaaaaagtcagtgcctccttatctccaaacaattgtactagctcgccagaaattgttcttaactaaattgagatggctgaaatgacaaacatagaactcagaatctgggtggtaaggaagcttaatgagattcaggagacagctgaaacctaatccaaggaatttggtaaaatgatccaagagttaaaaagttgacaaagccattttaagaaacaaacaaactgaccttctggaattgaaaaattcactacagaaaatttcataatacagttggaagcattaacaacggaatagaccaagatgaggaaagaatctcagagctcaaagattggtccttcaaatcaattcagtcagacaaaaataaagaaaaaagaatttcgggccaggggtggtggctcatgcctatgatcccagcactttgggaggctgaggtgggaggatctcttggggccaggagtttgagacctgcctggccaacatggtgaaaccccatctctactaaaaatacaaaaactagtgaggcttggtggcacgcgcttgtagtcccagttactcaggaggctgaggcatgaaaattgcttgaacctgagaggtggaggatgtagtgagctgagatcacgccactgcactccagcctgggcgacagaccaagactctgtctcaaaaaaaaaaaaaaaaaaattgaaaatgaacaaaacctccaagaaataagagattatgtaaagagaccaaacctatgactcactggcatttctgaaagagaagaagagtaaacaacttggaaaacatatttgaaaatatagtgcgcaaaacttttcccaatctcactagagaagtcaataggcaaatttaagaaattcagcaaagtcctgtgagataccatacaagatgaccatcctcaagacatatagttaacagattcaccaaggtcaatgcaaaagaaaaaatcttaaaggcagctagagagaaaggtcagcttacttacaaaggaaatcccatcaggctaggagtagacctctcagcagaaacttgaaacttacaagtgagaagaaactgtggacctattttcagcattattaaataaaataaactccaaacaataatttgatattcttccaaagaaagcttcataagcaaaggagaaataaaatccttttcagacaatcaaagctaaggaaattcatgagcactagaccagtcttacaagaagtccttaaggaagtgctaaatgtggaaatgaaagaacagtacctggcaccacaaaaacacaagtacatggcccacagacaccataaaggagatacacaatcaaatctacaaagcaaccagccaacaatgtgatgacagcatcaaaatctcacatattgatataaaccttgaaggcaaatggtctaaatacccaacttaaaaggcttaggatggcaaaatggattaaaaaaataaggcccaaccatattctgtcttcaagagacccatctcacatgtaagaacacccacaggctcaaagtaaagggatggagaaagatctatcatgcaaatggaaaacaaaacgaaagcaggggtcactattcttatatcagataaaacagactttaaaccaacaatgatctaaaaggacaaagtagggcattacacagtgacaaagggaaaaattcaaaaagaagagttaactatcttaaatatacacacagctaacattggagcacccggattcataaaacaagttcttctggacctatgaaaagacttagtcacacaataatattgggagccttcaacacccaactggcaggattagagagatcatcaaagcgaaaaattaattaataaagaaattctggtcttaaattcaacacttgaccaattggactcaataaatatctacagactagtccactccaaaaccataggatatacagtcttcttatctgcacatggaatatactctaagatcgactatatgctcagccataaagcaaatctgaaaaagattaaaaacactgaaatcatctcaagcatactctcagaccacagtacaataaaaacagaaattactaccaagaagatctcccaaaactacacaattacttggaaattaaacaacttgctcctaaatgacttttgggtaaacaaatgaattcagaaatcaaaaaaattctttgaaattaatgaaaacagagacaaaacaaatcaaaatctttgggatgcagctaaagcagtgctaagagtatagtttatagtgctaaatgcctacatcaaagaagttaggaagatcttaaatgaacaacctgatgtctcacctagagaaactagaaaaaaagaacgaatcaatcccaaactagcagaagaaaacaaataaccaaaatcagagcagaactgaatgaaattaagatggaaaaatgcatacgaaagatcaacaaacaattttttttttttgagatggagtctcgctctgtctcccaggctggagtgcagtgacacaatctcagctcactgcaacctctgcctcttgggttcaagcaattctcctgtctcagcttcccaagtagctgggactgcaggtgcatgccatcacacctggctaatttttgtatttttagtagagacggggtttcgccatattgatcaggctggtctcgaactcctgacctcaggtgatccacccgcctcggcttcccaaagtgctgggatcacaggcatgagccaccgcgcctggtctgttttttgaaagaataaacaaaattgatagactgctagctaaacaacaaaaaaaggaaaatctaagcccaatcagaaatgacaaagatgacattacaactaatcccacagaaatataaaagatcttcagagattattataaatatctatgcacacgaaaaatagaaaatctagaggaaatgagtaaattcctgaaaactcccaagattcaaccaggaagaaattcctgttcaagaaaacctgaacagaccaataatgaattccaaaagtgaatcagtaataaaaatcctaccaaccaaaaaaagccctggaccagacggattcacagctaaagtctaccacatgtacaaagaagaactgctaccaatcctactgaaaccattccaaaaaattcaaggaggagggactcctctctaactcattctatgaagccattatcaacttgataccaaaatctgacagagacacaatgaaaaaaaagttcaagccaatatccccgatgaacatagaggcaaaaaaaaaaaaaatcctcaacaaaatactagcaaaacaaatgtaacaacacatcaaaaagataatgcactatgaccaagtgggatttatccccagaatgcaagtataatttgacatatgcaaatcaataaatgtgatatatcaacagaatgaatgacaaaaaccatatgagaatcttaatagatgtggaagaagcatttgataaaattcaacatgctttcatgataaaaaaaaaaactctaaacaaatgaggcatagaaggaacatatctaaacacaataaagacgatatatgacaaacacacagctaagatcatactgaatggggaaaagctcaaagcctttcttctaagaactggaaaacaggtcaagaatgcccacttttaccactcttattcagtataatgttggatgtcctagccattgcaattagtcaagagaaagaaataaggggcatccaaattggaaaaaaaggaaattaaattgtccttctttgcatgtaacatgactatatattcatatattcatatatatatgtatatatatatatatcccccaaaactaatgactctaccaaaacactctaagaactaataaactaattcagtacagttgcaggatacaaagtcgacatacaaaaatcagtgatatttctagactccaataacaaactagctgaaaggaaataaagaaggtgatcttatttacaatagctattaaaaaaaaaaaacacctaggataaatttaaccaaaaaagtaaaagacttctatgaggaaaactataaaacactgatgaaagaaacgaagaggacagaaacaaatggaaataatcctatgctaatgaattggaaaatggaatactatgcagccataaaaaaagagtgacatcctgtcattcacagcaatatggacaagtctggagaacattgcattaagcaaaacaaggcaggcacagaaagataaatactgcatgttctcatttatatatgagagctaaaaaatcaaactcatggaagtcaagagtagaactgtgggtattaaagatgataaggaaaggttggctaacaaatacaaaattaagctagataggaggaatgagctctggtgttctgcatcactgtagggcaaatatggttaattataatttattgtatatatttaaagagctaggagagaagatttttgatgttcacaacacaaagaaatgacaaatgtttgaggtgatgcatatgttaactaccttgatctgatcactacacattgtatacatatatctaaatatcactctctgtaccccacaaatatgtacaattattacatgtcaactaaaaataaaaggaaaaacaacatagatggaatcattttaacagataaaacttgagaataaaaataatcataaaggaaatattgtaatcatcacatctgattcctgtgtctatctcttagctggttccaaattaaaaacaaaagtaaaggattgtgaattattgactcaaactcaattatattattatgtttattttgcaaatgagaaaactagatttgagagaggatgagcaatttacccaaagtcaccaaaatctaaagtatgtggcaaaacaggcagtcaaacagggacccctcattaactcagaagtctacattttttctcacattcttatgtgcttgtcacttatattcattaaaaacaggcacattccatcaacattctctagtaagagtctaaacaccccgtgtaagatacagggaaggaaaaggaaatggaactcacattttctgtgtatctattatgttccagacactgtcctaagccattatttacaatacatactttaatcctcacaaacacccccaggaacctgcagcaagttcggtgagaatcaggtatccaaagctcatgtgcttttgatttactaagttgcttttgaagaccaaatattagtcttccaaatgatcaggctattaaatgtagtgtgtaaacaccaacagcatcagtgtatctgcttgattcacacacttactgaacagttctttacgatggcacagaacacgacatccacacataggaacacccctgtccggcctatgccggcactgcagtgaacaaccatgggtcctgtaaggtggctcttccttgcataacgaatatattttatgaagctatctgctgaggcaggagtgccatggtctggccacttggtgaactgcaactgttttacagagtgactagttcccgtctgttagagaaagaaacagagcgagaaagacatttattgatttcttatattagagacctcacgccaacttctaatattcaaatgataataataatggctatatggtattaccttggtattatatagaactttcaaaaagtactcaaacctctttttgatgtttataagaattctggaagttgctaggaatagaggttttctccattttacaaaggagagcacagtaacaacaataaaaataccagtattaacaggcaacaaaaattaagcacttgctatgtggcagttactatgctaggggcttcacatgaattctctcctttaatcttcacatcaaccatgtgagataggcaccattttatctccattttacagatgaaaatttaaggatgagggggacgagagatgtatgctaggtcagaaggttcacacgtttagagctggaactgtaatgtaggtgtcttgaattctaatctaccatcattcttctgtaccatgaggctacaggaaaaccaagatttcaaaatgcttagagtgagagatggactgtcatgttaggaataagaccaaaaggcaaagtatcttagtttagaaatgacatatgaaatttaattaagacatataggtgtctgacaagagaggcaccgatctcttccagcgatgaagacagggtagtcaatgaccatgagagtagattgtgggtcccactattgtgctgagcccccttgaagtggagtcatgaaactcttcccagcattgtcagataaagcactttgaatttacctatatctcatccaaagggatcatgaccctttcctcagtgtggggcccttattttatcacacatgggaacctaatggaagaactcaaaatgagtttctcacttctcctatgcttctcccgaatgcacctctttttcctaagctttctgaataaagatgctagtgctcagagctctattctaatccacagtgtcgactgaaatttgtgatagttaattttatctgtcaacttggctgagccctggtatccagatactaggccaaatattattttgtgcctctgtgaaggtattttttaggtgagattaacatttaaattggtagaatttgagtaaagcaggttattctccataaagtgggttggcttcatctaatcagctgaaggccttaagagaacaaaaactgacctcccatgagcaagaaggaattctaccagcagattgcttttggactcaaactccaattcttccctgggtcttcagcctactttcccaccctgcagatttgccaaccctccacaatcacttgaaccaactccttaaaattaatctctctctctggatcagtcccataacctgtattcagggatctcaatgttatactgctagaaaaatacacataatcacatattttgttgctactacaaatgtatgggtcaaacctcagcatcactcagcaacccttttcctggtgattgtgctccaatcaacttctttggtgatgactccaaaactcaccattctctgcaagtttcctgttcaactcctattcccttcactcttgttaacacatgtatcacctacctgccaactgaatccactagagcaatctaactcattgctttctcctataaaccattccttttctgttttctaagtctattagaccaaggaatccatgaattattctagaccaatgcttctcaacagaacttcctatactgaagcaaatgtcttaaatagtggcaatatagtagccactatcaacatgccactcataagccctaaaatgtggctacttgcaggtgaggaactcaatttgttattttacataaatttaaataacttaaatttaaacttaaatatccacatgtggttactgtattgaatatattttcaacccctcctctgtcacttataaatcataagtcataagtcacatatgtctcccaattttatctgcaaaacacttgcgtctgtgctttccacccccatgccaacagccgtagttgatcatgtcacttactaaaattcttcaatgtctcccaattatcttcataataaagttcatgctacttagctgaaatttaagacatttcacattctagctggcccctgcttacttttgagaacctcatctcatcttttattactccctggcactgaacttttacatttcagaaacacataactacttatatttgtctctacacacaccttatgctattttatattttgatcatctactttctccctccatctttttcatttgcataattctcaaaacaaatgccacctcctccagtaaacctgtctcaaaaccccaagtaaagccaagtgtttaccttctgagccccaaagtgcccaagacatatctcaacattatcactgaacacggtaagttaggtatctatcagtgagtgtaaccaacctctccactattcggtaagtactgatagtgcctggcccagtgattagcatactttaaggactcaatacgtatctgctacatttggcagaggcaggtataacccagaatcagacaacttcaacagtcactctccctgccccacctctcttttccaattttttcttctccacagaatctggttgaggagaagtagaagtggtggtggcttctggtaccagggacaagtaaaaagttacttaagaagtatcatcgatcgattttccatcctactcctaacttctagttctaagacatctgcttatgtggtgaaacatatatctaatactgatgtttaaaaacttacggacttctccacaacttgaaacattcgaatgatgaaatattgaagtatctggtagttctccaggaatacacggaagtgtttcaattccaatggcttcttcagagaaatgggccagtaatggtagcatttgataattccaccttctatctctctggttatcatggcaataacatttgaattattttccaacaccatttgccaaaagtcatctatggtgctcagcagtggtccttgagtagcgatataaaaatactcttctccacaattgactattctaatataactagcattgatgtagtccttgctttttccaagaggaacgcgtgttgaatcatctattacagaaacagaaacatctggtagataaaggtgggagatacatcacacccagacttcacgaaaggatttcacacatgtaaatccatatatctctttgaccaatagagaagatggcctaggagtttcttttcaaaatggttgagtccatgagtttaaattatttcctccctgaaaactattggcatgacctaagaaatatacaattatgggatgtttatttttcaaatcagtttttaataaatgcagaatgatatcattagcatccaggtacttttggaaatttctgctagaagtggcatgggcaaggttaagtcaagggaagtatcctatagtttgcaactgaacacaacagaggagaaactctttgtgggagtaaatgagtgatattatcctgcaaatctgaaacctgcaaacccagagcagcaggagccaggggaaaaaaaaaatctgatagttgactgcagacaaattctaggattaatggaattccaccactgtccccaaactagacagccatattttatgtccattctcagccttcatctggtgataggacatgttattcaaagcaaagatattgtggcaaaaggatgctaccaaggggaattgctccaagtaatatgggactcatctaacatggactgttataacaaatacgagagggaaaaccagctatttggcctactaaccttcactgctccaggagttccttcttcacctgacacagacatctgaagctctggttccaccaccatccccacagtgagagcagaaacacacacagcaaaggaggcccttctctgccatgcagctctctcaccaataacctctccttactactcagaatcacatggaccacttatctagtaaatatgctgacaagacctgaacaggcatttatataatatctggcagaactcttctcaaattttaacatagcacacagaaactttcccttgtaaatatgaatgaacagaaaaaatcagccaggcgcggtggctcacatctataatcccagttactcaggagactgaggcaggagaatcgcttgaaccagggaggcggaggctgcagtgatctgagaccgcgccactgtacttcagcctgggtgacagaatgagtgagactccatctcaaacaaaaaaaaaaaaaaaaaaaagctagatatataaagatacccggtatttcaaaaagggagaccattctaaaaaatcacaacaaatattctcctttctataaaagatgataacaccttaaaaactcctatttgtatattaaataaaattcaagagagcattaattatttaaaacaatactttatacctatgtttactaacaaatatgttatattactaaattataaaggtgataacaatggctttgtagggagatctttcatcatatttatgtagatatatgatgatatatgtcatataataataataagcctggcaagtgttcatcacaatgttagcagtagttattacagtatctaaaccatataaattacttcatagtaaaaaaagcattttttaaattttgaaatgagattaaatatgtgaaaattaaataatctaaaataataaaagcttgatttcatataaaagtcacaatcattcaactcaaactcctaaagcaggaattgaacagaaaaacaaatttatgtttagaaaatcagcttaaaaaattttcccagaactcagaaaaaaaagattaaaaaaacctacaataatgattaaaatggtaaaagacacagcgcatacaaggggaatgtaaaaaacgaatttcagaagcaaactgtggaattcactgcagaaaagaaataattcaagtgatcataggaaagctccctaaacagaagcaggagtactaacagaatgcagtgaaacatgcataccaggttcaagcagcatgatacgctacatgtatcaccttgtcaactccaaaacaaacctttgagggaggtgctattatattcatacttttcaaataaagaatctgtacaaagtaacttgttccatattatgcagcaatcttctagactccacagactaggtaaatctagactctggtccaaaaataattccatgctctgttgtccatcaaggaagactcaagtttgcagacagaaaggcctaagtgtcagacaacattaatgaagagagccactaagacccctagaccagcagagcataaggccacaggaacaggaacaggaagcaaaaattatgctaatggatgactaggggtaatggcaactggtgccactcccatttccaccccttgattcttgaatcttggctatggtagaaacagcatcatatattggatgctgacatggggcatgtataatctcctgaagaacattaccccagccctgcaaggtactgccacctagctttcactgtaattgagtcttcaaaaggccattcatccattctgtcaagccagccgctttgagaggataaggaatatggtaacatagtggcaatgaggccattgccacaaggtatttgccacaaagtgagttctttgattacagcaatgctgtatggaataccatgatggtggataaggcattctgtaggtccacagatggtaaattggtgggagcactgtgtgcagggaaggcaaatccatacccagagttactgtctattctagtaagaaaaaagcactgctccatgcattatggaagtggtcccagtgtaatcaacctgccatcagctagctggctgatcatcccatggaatagtgcccatcaggtactcaatgttggtctctgttgctggcagattggacactcagtagcagctgtagccaggtcagccttggtgagtggaagtccatgttgctgagctcatacataacttccatccctgccattatggccactttgttcatgagacctatgggcaatgacacaatgacaggggtgactgggggtatagtctagctgatattcatagagcatgtcactctattcacctgattattaaagtctgcccctgctgagatcaacctttggtgagcattcacatgggatacaaatatctttgtgtttgtgcctatctagcaagatctattcacgtgcctcttccccagaccttattgtcaccaatttttccaaccatgttccttcaaattccctgaccatccagctaagccattaaacatagcccatgaatcagtacacatttatacgtctggccatttctccaagcaaaaaacaaaaaaacaaaaagcaccaagtgcactacccaatgttctgcccactgggagttatttctcttcaccactgtccttcagagatgtctcaaaaaaggggctgtagtgctatagctgtcctcttctggctggtacctttatatcacgcagaaccttctgtagaccaggtccaagtcttctcttcttctgtcagctgatcataggcaactcctcatgagacaacaggtgctggctgaagagagcaggtaatgtagcaggggtgggaacagtgagcatttgggcagcttcttcgtgtaacttatttgtgccttcaggatctgctcaagcccaatgttgtatctaccactttcatttgatggtggagtgctgctgtgtatgcccaactttatggcttggtggcccatagttaagcattctctacttagttctctatgaagcagtctctaccaaggcccagtagcaggccaaaagctgtttctcaaaaagagagtccagagagggtggcaggaatttgctctaaaatcctacgtgcctgcactgtgattcatctaaaggggtctgccaaaggtccaaacagcatccttatctgccaatgacacttcaagcaccactggatctgctagatcatacagcccacgtggcagagaggcttgcatggcagactgatcctgtttcagagccttctcttgttttgggccccactcaaaactagcagcttttcacatcacttagtaaatggaccagagtagcacatcaaaataaggaatgtttcctccaaaacgccctggttcactagccattgtgcctcttttttgcttgtaggaagagccagatacaatttatccttcaccttatgattatctccacatgtcccacaacactggacctctagaaatttcactgaagtagaaggccactgaatttttgttggatatatctcctaccctctgacagacaaataagactaaagcatttgctacttcttgttcactagatccaatcagcacaatgtcatcaatgtaataaacctctgtaatatcctgtggaagggaaaggtgactgagatccctgagaactaaactacaacatagggctgaagagttaatacacccctgaggtaggacagtgagggtgtgttgttggccctgccagctgaaagtaaactacttttggtgttcttgattaataggtatagagaaaaaagcatttcccagatcaatagctacatagcaggtatgaagagatgtgctgattttctaaggcaatgaaactatatctggtatagcagctgcaactagagtcaccatctgaggaagcttacaataatccactgtcattctccaaattccatctcttttttgtgtaggtcaaataggtgagttgaatgggatgtgatagatatcaacatcacttcatccttaaagtccttgatggaggcattaatatcagcaatctcttcaggaatgtagtattgcttttgcttttttactattttcctaggtagaatcagttctactggcttccactggccctttcctgccataatattcctcactccacaggtcagagaagcaatgtggggattctaccagtttctgagtatgtttattccaattattcattccagggcttggaaaataatcacaagatggttttagggacctactgagtccactgtgaaatgaacttgaactaaagctccattgactatctgacctccataagcccctgctttgatttgtagaccacagtgatgttttgggtctcctggaattggtgtcagttcagagccagtgtccagtagtttctgaaagttctgactattttctttttccaaatgtacagtcaccctggcaaaaggctatagatccctttggagaaggctgaaagattaacagtatacatttttagcagtgtgccagggtcctccctttcattcaaggtgttctctgtgtgtaaactggctcaagtctgggaagttattgactggttgtgattctctgttcctatggttcaggttagaattttgctcacttgacctagaactcttctgcttacacctatcaaggaagaatttagtagacgtcccatctagttcacttctaggaacaccatgatcaactaatcaacaccacaggtctctacaggtcagactgttctgattgctgctttgactctgctattaccataccatgctcaccttgcctttggctatcaagtgccaccacctggcccttatctctctgggatccaattatacccactgcattcaggtttcccaactcagtggcagcaatttccactgcaatatctgaactacagagaagaacaatcacagtattcttcaaggattctgggactcgcctcacaaatatatttctcacagttatgagaaaagtacatcctctggacctcctggggtgggttggcaggtcttaaatgataaacctaatctaatattccaatctccctaatcctttggatcacagtatatagtatatcgaggcagttctggcattttatcttcatttagactgggccaccttttggtccatttaatacaaccaaccaaataaactgtaagagctctttctaactccctaatccacatattaagtccagaatctcttctttgtggtcccatttcaataaattcagcctgatcaaacactaagttccttccaccattgtcccacacccttaaaatccctccccacaaatatttcccagatttctgtcagtataaattggaaaaatcatgtagctcttttgtagcgtaacatacctccccatgggtcacactttgtaccttacctttaagggcctgctgggacttgagtctagttataggtctagaagcaatgaaggatggtagctgtgagtcttgagaagaatcagcaatgtcttgcaaggcaacaaactcaggggaggtaataaaagtttcctcaggtaaagtagcatcaatctcctcagatgggggtggcatggctgcttttactggcaaggaagactcatcagggtcaaggggttcgatacacccagctttataaggctcttcacatatgtctgcactccagttttcaagatcccattccttctcagttaatgccctcattttaacagcagacaccctaaaagggtggggattcaatttgcactgtaattcagccattttcaggatgagattttgggtttggttttcaataatctcagctttgttgttataaaatataagagtttctttcagggcagaaagagaaacttttgggttattcatgcggcacttgagctgggaaatttaatccctaagatcatcctttccttctctacattaggagtaactagccaatctcattgttctcatgagaactcaaaaatgttctaaggtatcaaatacagatgcccagaaccttgcttcttgtaaatgtctgaataggattacctaatggcaatactttgcatatctctactgtcacattacactatgaattattaatactctattcactactgaaaagtcattaatgcctttacatcttatcagattagggaagtaattcataaaactcatccttaaaattctgttcctctagaattgctctcagtaccaaattctgttactctagattctctagataaatagaatcaataggctgtatatatacagtgagaaagatttattttaaagaactgactcatgattgtggggactggcaagtcaatatctgcagggcaggccagcaggttagaccccagggaaaagttgacattgtagtcttgagtgcaaaggcagtctggaggtagaattccttcttcctctggaaattttagcgtttttttcttaatgacttcaactgactgaataaggcccactctcgttatggaggctaatcagctttactcaaagtctgctaatctaaatgttaattacatcttttaaaaaataccttcacaccaacatctagactaatatttgaccaaatagctgagtatcatagcctagcctagttgacacatgaaattaaccattaaacaagctaaaaattttagtagatgatttgaaggaggaaattttttaaaaacttatattagtttcctataaaaccaagtgaaagaaaaaaataagaataaaaatgagagagagagagagatagagaaagtacttgcaaaactacagaggtaaaagaagtaacgagaaaaggttttataagatagaaccaagaggcaaccctaaaattcatagaaactaaaaaaaaaaaaaaaaaagacaagagtagactgaagagtagaaattacaactaaaggaagatcaattaaagggtttatttgtctaggtaagaatgatggaaatgaagcatacctggtaacattatttaattccaggaaaatagttaaagattttgaaataaaagagcatatttctcatgaagaaaaggagtcagatggccattacagttctcatctaaaacactggaaggaagaggacagtgaagtaacactcagggaaaaaaaatgagaaaaaaaagaactaaaacccaagattcctaaaaccaacaaggatattcgtttatcaggataaaaaaaaaaaaaaaaaaaagtagagcttgagactgcatcaactacttatacccatctccaatcaaacaattaattcatcagaacagtgatttcaaattaagggaaaagggaaagaaaatgaagtaatagcaacaaatactacaaaacatagtttcatatctataagaagaatgacgagagccaggcattccagctacttgggaggctgagacagaaggatcacttgaagccaagagtttgagaccagcctaagcaaaagcgtgagtccctgtttctaaaaaaaaaataaatgaataaaaaattagctgggtatggtggcacatgcccatccccatagtcccaactacttgggaagctgaggtgggaggattgcttgagctcaggagtttgaggtttcggtgagctatgattatgctactgcactccaagtagactctgattcttaaagaaacaaaacagctctgtgcggtggctcatgcttataatcccagcactttgggaggccgaggtgggtggatcacctgaggtcaggagttcgagaccagcctgaccaacatggagaaaacccatctctactaaaaatacaaaattagccaggtgtggtggcacatgcctgtaatcccagctactcaggaggctgaggcaggaaaatcgcttgaacccaggaggcaaagggtgcggtgagctgagactatgccactgcactccagcctgggcgacagcgagactccatctcaaaaggagaaaaaaaaaaaggtttcttgaaataggaaagaaaacaatgtacaataaatacagtggtggttaggcctgggtttgaatcccagatctctctcctatttgcagtgtgaaagtgagaaaattacttatctcttttagcctttctgtaaacaaggacactaacatactgacaccttagaggtaggttgttgtggggattaaacattactacctataacagacttaaattagtaataagcaatagtaataaacatattagtgttactactactattattattagtgggtggtagtagcagaaacaaacatagagcaacctcaagaagtacagaaagaagcttgttaaatctctgccttgaagagcttgttttcccatctatctatattataatgctgaagtgtatgaaaattttttaaaagtgtaatataccttttgcactcacaaaccacctttttaacagtttatggaggtaaaactgtcatacatgtgcacccatgagaccaccaccacaataaagataattaaacatctccatcagtgcaaaactatcctcatgcctctttataatctatccttcttgctctcatcttgccccaaggcaaccactgagacgttctgtcaatacaaattagtttaaattttctaacattttatatatgtggaagcatacagtatattagttttctaggtttgaaatttattttcacattctggaggctggaagtccagtattgttatggtttggatgtttgtcctctccaaaccttatgttgaaaactgatccccaacattggaagtggggcctaatgggaggttttgagtcatggagacaaatcactcatgaatagattgatgcccttcctcagggttgagtgagttctcactctattcactgctgcaaaaaccgattattaaaaaggaccaggcacctctctctctccctcttgtgtcctctttcaccatgtaatctctgcacatgctgattccacttcaccttctaccatgagtggaagtagcctgaagccctcactagaggcccaatcttgaaccttccagccagcagaactgggaattaaataaacctcttttatttataaattaaccagccccaagtattcctttatagcaatacaaaatggaataagacagaaaattggtactgagaattggggtgttgctataaagatacctgaaaatgtggaagcagttttggaactgggcgatgagtggaggttggaagtgtgtggaaggctcagaaaaagacaataatatgagagagtgtctggaaaaagtgcccaaaggcacttcagaaatatttggggccaccccttccctaataggccccaaggccttctggggacagacctggagcaccactgcccttggccacctcaggatgctgctccccacatcctggctgctctggctccagcagtgggtcaaatggccccaggtagggtttgggccactgctcctgaggggctaagtggtaagccttggtggcattcatgtggtgttaagtctgcaggcatccagaatgcaagggacatggaggcttggcagctttaacctaaatttcagagaatatattaaaaagcctgggaaagcaggcagatgcctattgcaggagtggagccaccaaagagagcccctaccaaggcaatctttagtggaaatgttgggttggagtttccttagagtccccaccagggcaactcttagtggacccacaaaggtgctggaaccccacaatagtagagctatccacagcattccacctcagcctgaaaaagctgcagcattattacaacccatggaagcagccagtggtctacgcccagcaaagctatgggggaagggctactcaaggccttgggagcccaccccacacaccactgtgaccaatatgtaggagatagagtcaaaggagattattttggagctttaagatttaaagtgtgccctgctgtgttttggacttgcatggggcctattatccctttcttttgaccaatttttcctttttggaatggaaacatttacccagtgcctgtaccaccattgtaccttggaggtaaataatctcttttttgattttacaggcttacaactggaaagaacttactttgagtctcagatgtgactttgaacttttaagttggtgctgaaacaagttgacttttagggactattgggaaggaataattgtattttgcaatgtggtaagaacataagttttaaagggccgggggcaaaatgctatgatttagatgtttggcccttctaaacctcatgttgaaacttgattcccaatgttggaagtggagcctaatgggaggtgtttgagtcacaagggcacatccctcattaatagattaatggcaggagtgagctctcactctattcgttctgcaagagcctggtacctccccatttctctcctgcttcctctctcaccatgtgatctctgcatatgctggttttacttcactttccaccatgagtggaagcagcccatagccctcaccagatgcccactcttgaaccttccggtctgcagaactatgagctaactaaatccctttccttcataaattattcctctatagcaacacaaagaaactaagacaaagatcaaggtggcagcaggcttggtttttcctgaggcctctctccttggcctgccaatggctgccttcttgctgtgtcttcacatggacctttctctgtgcctttgaatccctgatgtctcttgtgtgtcccaatttcttctttatataaggacatctgatggattggattgggcacactctaagaacctcattttatattaattactactttaaaggccctatctccaaatcaggtcacattctgaggtacaaagggttggaacttcaacatacaaattttgggagaatttaatttggctcataacacacagtatatactcttttgactggcttatttcactgagtaaaattattttaagattcattcatgttgttcaatgcattgttagtcattttttattgcctagttgcattctattatgtagacataccacaatttgtttattcactcttccgttgatgggcatttgcactgtttccagtttttggctattataagtaaatctgatatgaacattagtatataagtctttatgcagacatatgctttaatttctcttaggtaaaacatatgaatagaactgctaaatcatatggtaggtacatgtttaactttattagaaacaaattccatttcattgcagtgagtgtaaaatggtatctcattatggttttaatttgcattttcctaatgatttacaatggtgaatatcatttcatgcatttatttgccatccttatatcttccctgagaagtgtctgctcaaattttttgctcatttagtgttgggttatttgtcctcttcttgatttgtagtaattatagattataaatataagtttttgtgagataaatgttttgcctgtatttttcttctagcctgttgctttcctttttggttttataataatatgctttgaagagcagggttttttttttaatttgatgaagtccaatttattttttttcttttacaatttgagggttttgtgtcctatttaggaaaaatttgccaaagccaagggcagtaacgttttctcctagggtttctttcagaagttttatgtttttaactctaatgataggtctataatctattttgagttaatttttatataagttgtgaggtaagaatcaaagttcatttttggtacatgaatatgcaactgtccagatgatttgttgaaagattatcccttccttattgtcttgcattaaatttagatattatcatcttctctgttcttctcacatgatcatacagaacactcaatgagaaatatataagcatgctctgaaaagtgagaagctaacagaaacctaagtcactaccttgattagttctgaataggtccctgatagataagtaacagaaaaaatattaggccaggagttggggaacctctgtgactcgctcttttattagccttcaaactgctttgtaagttgtgaaatggtaaagaaatggaagatattgtctttatacctaaaaattcctatactacataataaaggccattcttgcttggcatgatggtacagggccataaatatgaccatgcaagttgaaaccatgcgaaaggacctttgttgttgttgttgttgttgagacggagtcttgctctgtcgcccggggctggagtgcagtggcgctatctcagctcggctcactgcaagctccgcctcctgagttcacgccattctcctgcctcagcctcctgagtagctgggactacaggggcctccaccacgcccagctaatttttttgtatttttagtagagacagggtttcaccgtgttagccaggatggtcttgatctcctgacctcctgatctgcccgcctcagcctcccaaagtgctgggattacaggcatgagccaccgcgcccagtcacaaaaggatcttagtaattaataggaaatattattcttgtttcatggctcttaacattttttgtgaaatcattaaaaactcacttattgctggctatacatatatagagaagcaaaaaatagcaagactaatatttatttagaacattgtaatttaaaacattagaaatattgggaattaaagcatttaatttgttaaaaaaaaaaacaaaaaaacaaaacttacccagagtagtttgaacagtgtttgcctcttctttttgttgtataacttacaatacagagtgagcattttttctatgtctaggctaacttccaagtctggatcagtttccaccttttatccttggcacttatattgttgtgaaatagctccaaagtttctttaatgtcaagttttctaccatcattgcttcccctaggttgcctttatccttttcctcacaagcactttggtcattcatgtcggtaagttccccttccacaggtgccttaggctgcagctctagggtcttttgagcagtagcagtgtcagcatgtccctggtcagctagttcttctataactccattcaaatttcatttccaacattatcactttttatccctttattgcagtttcatctctctcagccaaatctctctcttgattatacattttggtaaaaggtcataggggtttaccattgagagacaaggagacaatacaatcacatgctttgctgtgtgtgaactgaataagaggctcacagttacctatcactgacatattttgaaagaagtaacatttattagtcactggtcatgatgcacatctgttatttacatagggacttgtggactaaagtgccagcaaagatgcttactactttaggcaattacttgcagtgaatatattgtggtaactaaaatgtgaattgtactgtgggactggtgttatttagctaaacacagtaactgatatttgagcatattggggccatgcaaagtgaaggttccctatatttgcagtgttcaaaggtgtgtgaattcatctatttagtgttctcagcatttgaagacgacaaataaattacttctttagctttcttaatatgagtcttcaggaaccttttctataaagtcaagaaatgtgtgattaaaaaaaccacagagctttctatgatggccacttaagttggctgagtttcagattagattacactgcgttatgaggtagatataccaatgggcctttaaaaagaatatggttgaattatagtttcttttcttttatgaaaagccaaaagttttacataacttcccttactttaatgatttaacattatttttattatctttgaatttcttagttgtaactcttttgatatccagaataaaaacttcaagtcagatcaaatattatgtgtaccttctattgtaaaatgagcttcttacaatcccgagaggctaatttttaaggcatgtttgcttttagtctccttgagggcaaactgcacatgcagaaatagaaattataaaatttggacctttgacattttggagaagcaacaaattattagtattatttattaaaatgtctaatcatggttcattattctgatttcagaagtattcatcaatgcacttctccacactctccccacagaagataacagaatagcttattttaaccatgttggatatgtacttgttttttatcatcataaagttagtttcaattctaataaaccaactaaacatgaaggtatttatctagtgaccgcagtcactgtgttccactctggtttttataataactatctcaagtctagtaggagaaacaaaagtgaaaataattaaaatatggtttggtagaaggggagagtggttacaagatgctgtgagactactggaaaaacaccaaacctagctttgaggaaaataagaaaagcctattggagctggttaagaaagatagcaggaactgcctcagcaaagaagggatgagtagttctttcaagaactgcaggttaagaggcataaaaaccaacaaataagaaaagaattatgaattctagataccaaaagaagttttgtgggagagctaaggctagagaggcaaacaggtgaaattcttaggccatgttaaacaactgtaccatgatagtaacaaagagccaagaaagagctttaaaagaagagctacatgttctgacttgcattttaagaaaatctcagtagcttttgtgaatgatcagaaagggaggcagtaaagaagaacgtaaccagctgagaggtaaaatgggctcagtctaagtcagcagcagtgggaactgagagatgggggaggaccccagaggtattatggaggtagaatcaactgactccctgttttctggtttgaacttggtgattacataagatatagaatataagaagagggtcaagttggaggaagtaaaatagtaaatttagttttgaaaaactttgactttgaaaggaatgtgagttatggaatgagatatcctgcctaagattaaaattgcattgctgtgttttgattctgctctttgaatggcctgagatggataactcctaagagtaactgagtgaggaggacagaaggtgccactaccctcccatccaacacagggaagcaacgttaaggctctgtggagacaatcaaaaggcagcctcctgttggagagcagattagcagctttattgtccaggatgaaggatgcaaatagctcttttttcgcgtgtctaaacaaaatagccagagaaggtggttaaggcttcgggtaccaaaagtggtgtatgactcagactattggattttatgttttggaaggctcatgctctgagaagcagcaatatatgagaacaaggctgaaggactgctgtaaaggaccctgtaacagtggctgaaggatgtaccagaaaacagaggacctgactctctcatatctagcacatatcttagaatatgcccagatcacccagtgctatgtaccagaaccctttatcatggtcacaggccaaaatgtctcatacaaaaagccatacagtgccctttgcactttttctaaatataaacaggaaaataatcaaaactatttttagcttacatggaagaatatctcggtatctgtttttttctctgttgcttggttgattcccagagttgaactcaccaggcagattcttaagttctaaagcctttaaaaggttaaaaatgaataaataaataaataataaattgtgtatttactataaccaataaaaaagaaaaaaatatgcctttgtttagtgctcatgatccttaaatccctatatgacatgacctgctatttaatgtgttgtatgataagtgaagctagatcctcatttaaaaagtgctatataaaatatctcaagtttcacatgccaatcaatgagttggttaataagaaaatgttaaactttctggagatactttccacttgaacttcattttcttcttctttcataaaaaaggaaatacaagctattcatttctcagaacctacccacagatctatcattttataaataaaaataacaacataacaacaacaaaaacatataaacaaaaaatatatacaaacagtctcacaatttacccttcccctttgaagaaattatagttaggaccctaagaatccttcctttcaaaaaatttctttaccaagtgtgaattcaacaaacacttattacacatttagtaggtacctggccctgtttcagacactggaatacagggatgaattggataatggcctcatccttaaggagtgaagagagtagttagaggacatgtaatcaaataccatgtgaccaatgtacggagacagtagtataaatgacagcactagattgcacctaaaagtcaagaagaaaagctcctcaaagggaaatagcccttgaactgggccttagtgagtcactggaagttagcatatgaaaaacagtgtgtatttagaaggaaagaggagagaaggtgaaggggtggaaataatggaggcatacatgtccctttgggaaactgtgactaatatggtaataagagcacaaagcacatgatctagtccaacaacagactaaaactataaaatatcttgtttcatatataaatgaaattaggaggtagctagtcatactttattagaatatttgtggagaaagcctgaaaatctatacattttcaaagctcttgggtaactcttgtgtagccaacctagcaaccgctgccatggggaacaaggagcctgtgaaggttttaagtagtacaataaaatgatcaagtctttctgaaaatcaattttaaaattaatctggaaaaaattctgtaggaagaatgagaaaaaattcatttatgaatgaataatgatggcagatgagtctcattagatgttaaaagataatatgaagctatgctaattaacagaacaataccaataaaggaataagaaaatcagtagaaaaagtccaagaataaattaaaatatatgtaaggctctagtatatgataaaagtggcattttacctcactcaagagaaattccaggagagtcttgggacaactggatagttatataatgctgagtccctatcaaacatcttataccaaattaaattctagctgcatcaaagatttaaatgcttaaaaatcataaaggtactagaaaaaaacatgaagtaattattacaatcctagagtaaaagaagcattcctaaagagcacagaaagccccaaacccagaagccccaaaagcaaagattgccatatttgaccactaaaaatcagctatttcttcacggtaaataggcatgtgtgtgcacatgcatgtgcacctgtgtgtaacacaaacaacagcagaaaaaatactacgtgtaagacacacaaaggcataattttttccttaaagagttagtaatcggccaggcgcggtggctcacgcctgtaatcccagcactttgggaggccaaggtgggctgatcaccttaggtcaggagtttgagagcagccctggccaacatggtgaaaccctgtctctactaaaaatacaaaaattagccaggtatggtggcaggcacctgtaatcccagctactcgggaggctgaggcaggagaatcgcttgaacctgggaggcggaggttgcagtgagccaagatcgcaccactgcactccagcctgggggacaagagcaagactcatctaaaaaaaaaaaaagagtaaccaataagaaaaaaaaaaaaaaggaaaatggggcaaagaattgaaactagcagttcactgaaaatataaaaggcttaaaaacatatggaaagatattcttttgttctcaaataaataccaattaagtaatcaataagaaataatttgtcatttaagagatgagaaaagatccaaaaaattgatagcccaaaatattaatattgtctttctaggaatttgttcaaaaaatatttaaatatatgcatacagtatatgaagagagatgaccgctgttcataatagcaaagactagaacaacctaaatgtccaaatgttccatggtagttaattatatggataagtaccctaatttcagaaattaaatattaaataaattaaggtacttatccatataattaccatgcaacacttaaaaaaatgagatactgctatacatgctgataatatacttggaaattgtatctaggaggaaaacaaatttaaggatgtaaagtgcattccgacaaatttttttaaaagtttgcatgacaaaatgacaaaatgaatagtgtaaaggggccctagaaagtcttgagagaaagagagagactttctattttatatccttttatgctatttggctttttttttaaccacgtacatctattactttaaaatatatataatatttaaaagtaaaaacaatgtactagaaccaaataaagaaagaaaagaaaagaaaccctctggcaatgatataaaaaaagaaatcacatatagactttcgttaagaaaatatttaccataaattcctgcatgatatcatacgctgctgttttttcctcaaggattttcaaacaatccttgatggctgtctgctcatgaaaattgaatattaatggccgaatctgagccaactgatctagttctccttcagaaacaattttgcgcgtatctaaggaagagaaaaattcacatatgtaagttactggtatatatgtgaagggagattttatttttgtttctgtttctcttaaagacacagccatttaagggtaaacagaagtttatttttccacgggtgaagagtctactactttgaaagaggcttcctttggaaaaatcatggctatttacaccttgaaattatacaaaatccactgcccttggagaaaactgttcagtgccataaacataacgaatgctgtggattgagaagtgttcagttttataatgtgaattgggtatatggattgaaaattatgccaaggcaagaacgtccaaggcttggattaggaaagagaacttttgccctccctgggaccaagtgtttggaagttcctagagtctgagatgtggtgacgtggagagttcacgtcctgtttcattactctgaaacagattgaacatgaacgcacacacgtgcacacacaccaaggatggagaggatctatgcaatataattaataagatggaataatggatacgtatggacacttgcaaccaataattggggagaacattctattaatatttaatagcacacatacaatctttttatttttaattatgatcttttaggtaatgttgacagtcaaggttccaaacatctgaaattttatacattatgtccactggccaaaatgcaataaatctagaagtcaacagtaaaagagtattttaaaagcttcaaaattttgaggtaagatgttcaagtaaaacaagttctcataatctctttgcaaagccaaataatgtgaacaataatcaagttaataccagcaaaaagatatatacaaaacaatatagcaaaagaaagaggtggaaatttctaagaatctgcacattcctgggaagcacatcttatcttggtactccactatatccagaggctctttgtagggttggaagtgagggctcttggttgggatagacaggcacagaaatcctaaaatttctcacaaatatccctaaccttagtatgagaggaggtctaagcaggctggaaggggagataaaattcccacaagcgtagaagccattttgatcatctttgatgcccaacagaaaaacccttagatcttcccattgtgttccacctttgctagtacaaaagctgggagaatgaagagagaaaaaaatgaaaatgtagaatgactgtaacaaacactggtgttgactccccaacactgattctacccctctggttagttaaagccatttgtgatcattccatagtaagatccttccagtgaataattcagaaataggtaggagatttgcgccaaccatagaaataggctggtcttgtaaaaaagagaagcaaacctctcttctaccctcatccctctgtacagacataaacaaagaagtataaggacctaattatcatagtctgccctcttatggccataaaaggaaagcgtatagcaaatgtgaaaaacataaagaaactatgttcttgatgacattagcaactgatcatattgaacctggaatccttcctatctctgggcttccattatggtagaaaatatatatatctttatcattaacatcattctgaatttggtctctttttcttgtagcctggtccaagaattccaatcaaagtataaaggtgaggtttcagctgtagatcctgggaatcatttcagccagtttacagaaagggatttgatctagctatttggtgttgtatcaccattgtgtgggcttgaagaacagatgcctctctcattatgatccaagaacaacactgcataatggtctgccaagaaaagttctgtctttgccacaattaggaaactgaggaagttggagaccattttttctagccactggctcctagatgacaccacttcagcaacaatggagaaataagaaagtcactaccacaactgttggctctagtaacacatcaccttacctataatgaggaccaggaacgccaagcctgctatgatgcatagcaataaaatggatgcctctctacacatttacatcttggctaagtgcatatgatcggcaaagcccaaataagctaccaggaagtcttgaaaatgtaatttttcatttttctgcctgggccatacaggaaggtacactaggagaagggtgtgactgatattgagtaagggcatctgtgatatctgcttaacatttcagccacaccatgccctttgagtatcctgctccttggcccctatcccttcagcacacttatcattgtcctcgggcaaaataaacaatgcagccctccaaaatacagtttacaagggaagatgatgagatccaaataaaaatggaaatcaggaagaattcattcctgctcaatcaacaaaaccgaagagacagaaaaagctatacatgttcataacaaaatggaataaaatgtgaaacacagaaaaaataataatataatatagcatgcagaataatttttaaaatctattctaaaatggaagataagcttaaaaaggaaaatgaactgtgtatgcaacatctgtcgaaagaaaaagaaaaattattttaaataagagttcacaaggagataagaaaacaatagaatgaggtttaaaaaaattagtttataaacctaagaaaataaaggtaaaactcaaaagtacataattacagcaataatttataattaaatcgaattctgcaagaaacaaagcaggcagttgaaaatcaacttattgccataggacaaaggcatgtatacatacagtaatgaagacaagaaaggtttaaaaacacagtgaaaagataatgcatgtgaggacctcatcagaggctcaggagaaaagctgcagacagggtgaggaacttgagaaatcctccttcgtggggcaagcttgggaaggggaaaaacagcatccacaggaatggcacaaagcatgcccaaaatgcttttccctatttccctaatggaccaaaagcataagaacctgagaaaacgcatgaaactctgtcatcctcaaggcacaaatgaagactcattaacattgggggtagggaagagagaagagcatcctggacccaggccataagatattccctacacctgcagaatggacaaaataataaaggaggtaccgcctgaggccttcctaagactgagactgaacaaggacagcagagaatgtcaccccaaccaggttggcaagcaaggtaatcataagtaagagctctctactgctgggaattagagaagatcatggagaagaccttctctgaggtgcatgtacaatgggaagagctaaagcagagggtggagtaaacactgaggcaaatcctctacatgtaaggtaacactggaggaatttgaagctggtggtgcactaagggtaaccatagcaacatcaaacccaagccctgctgcattactgagtaaattgatgcaactcctcacactgaaggcctaccaacaaaagagtcatgtccatccctatttacctcagcgtctagaacttagctaagaaatactacaatagctcccccttatctgcaggggatatgttccaagacccccagtggatgcatgaaactctggatagtattgaacctgatcgtcatcaactgaaacatatttttgttcatgtcttccacccataaatttaatgccttttccatcttaagtaagcatgtatcatgcactgtggccataactttggcactctgatgtgcaacagcaaaacttggatagaagattcattcttaccataggtctacgcaactttagcatatgatttttttctttccttattaagtcaagaactttcaccttttcatgtaaagaaagcactttacagcttccctttggcatatccaaattgccagcatcactactctttggggccattactaagtaaaataagggttacttgaacacaagcactgtgaggccaaaacagtagatctgataaccaagatgactactagttgactaagagacaggtagcacatagggcatgaatatgctggacaaaggaatgattcactcccaggcaggacagagcaggacagtgtgaggtttcatcacactactcagaacagtgtgcaatttaaaacttattgtttatatctggaattgtccacttaacatttttagtctgtggttgactgcaggtaactgaaactatgaagagtgaaaccatggataagacatttttacttctatctctagactatacaatattcagttttcaaccaaaaaattatagagtacacacagaagtaagaaaaagagaaaaaagttgccaagagacaaagcaatcaacagaaccagacagagatataacatatgttaaaactgtcaagtgatgaatttaaaatagtgataatcaatgtgtgaaaaggcagtgggaaaagtagacaatatacatgaacaaatggagaatttcaatggagagatggaagccataaaaataataaagtggaaatgcttaaagtaaaaaaaatattgtaagaaattaagcatgttattgataagctcatcagtagatttcacagaggcaagaaaagaattcatgaattacaaaatagatcaagaggaattatccgaattagaacacagagaaaaaaggtagatgaggggcagaggcagagaagaagagaccatccaagaactacaaaccaatatcaaacagactaatatattatacctgtaaatggaatcccaaaatagaagagaaggagaattgggcagaagaaatatttgaaaagataataactgagaattttttccaaaatgaatgaaagacaccaagcctcagatccaaaagctcatcaaaaacaatataagccagaagacaattgagtgacaactttaatgtaatcaaagaaaaaatcaaaataaagaaattaagatttcagtaaatacatgactaattataaaagctagtattcttgtaacaataatgtgtaacttcactttttcttttctacatgatttaagagatgactttttcctaaatttattagcctaaaaataaaaaaattatcataactttagattgtaaatcaacattttgttttctacatgagaaactaaagcattaaaaacattattttatgttttggaacacataatatataaaaatgtaattttgtgacaacaaatgaaagagatggggtcaaaactgtcaaaggtccacagtttttttttttttgtattttactgaattaggctggcataaattcaaattagagtgataagtttaggatgttaaatataatgcccatggtaaccacaaagaaaatagctaaaaacaatacataaaggaaattttttaagaatttaaatatttcattacaaaaggcaactaaatacaaaaggagacagtaaggcaaaaaaaaatgaggaacaaaaaagctacaagaaatatttttttaaaatagcaaaatgacagaagtctctccttatcagcaattactttagatataaatgaattaaactcaccaattgaaagaaagattggcagaatggattaaaaaataaaaacatgatccaactatacactgtctacaaaggactcactttagatccaaagacacgaataggttaaaagtaaaagaaatattccatgcaaacaggaaccaaaacagagcatgaatagctatattaatatcagataaaatcgattttaattttaaaaagttaaaaatgacaaagaaggacattatatatcataaaaggttcaatacagcaagaacatataacagttataaacatttacacgcctagtaacaatcaaaatacacaaagcaaaaattggcagaaatgaagagagaaacagttttacaataataattgaagatttcaatatcccattttcattagtggatagaacaattagacagaagtaagaaaagggaggacttgaacaatataataaacaaagtatatctaacagatacatacagaatcctctgtgcaacaacagaccacatatttaagaacacatggaatattttgcatgtgttaggctataaactaagtatcagtcaattttaaaacactggtatcacaaagagtatcttctcaaaatacaagagataaagttagaaatcaaatataagaaaaactgataaacttacagatttgtgaaaattgaacgacataattttaaaacaccaatggatcaaagaaggaattacaagggaaattagaaacatttagaaatgagtgaaaacataacacaacatatcaaaactatgggacacagcaaaagcagggttaaggggaaatttatagctataaatgcttacatgaaagaaacaaggcctcgaataaacaaactagctttacaacgtaaggaattacaaaaagaagaacaaactaaacctaaagctaacaaaaggaagaaaatagtaaagattagagcagagatcaaaatataaaatataaaaaagagaaaaatcaatgaaaccaaaagcaagttcttcaaaaatatcaacaaaatgatgtgatgaacctttaattagataaactaagataaaaagagaaaagactcaaactactaaaatcagaaataaaaatgaggacattactaccaattctaaagaaataaaaaagattataagggagtactatgagcaattgtatgcagaaaaactggataacctcaatgaaatagacaaatttatagaaacacaaaacctaccaaaaccaaaccacaaagaaacagaaaatctgaacagacctatgactagtaaggtgattgaataagttatcaaaactatcccaaaaaagtaagccctggatccaatgccttcactgttaaattctatcaaacatttaaaggagaactaacaccaatacttgtcaaactgtttaaaaaaattaaagagtagggaacactccctaacttaatctatgaggccagcattatcccaatatcaaagccagacaattatcctacatgaaaagaaaactaaaggccaatatccatcttaaacattgatgtaaaaatcctcaacaaaatagtagcaaagcaaatatttagcggcatattaaaaagatcatacaccatgactatgtgggatttattactggaatgcaaagatgacttaacatacaaaaatcaaggtaatacaatacgctaacagaaaaaaaggcatgcttatctcagttgatgcagagagagtatttgacaaaattcaacatcctttcaagaatatattctttttgagacagagtttcactgttgcgcaggctgaagtacagtggtgtgatcccagatcactgcaacctctgcctcctgggttcaagtgactctcctgctctgcctcagcctcagcctcccaagtagctgggattacaggcaactgctaccacgtctggctaatttttgtactttttctttagtagagacatgttgcctagggtggtcgtgaactccccaacctcaggtgatctgcctgccttggcctcccaaagtgctgagattactggcatgagccaccatgcctggcctatttgtttgtagaaaaaaaattcaacaaactaggaacataagaaaaatacataaacataataaaagttatgtatggaaaacccacagcaaatatactcaatgttgaaagagtaaaagcttttcccctaagatcagaaacaaggcacggatgccacttttgccacttctatttgacataatattggaagtcctagtcagagaaattaggaaaaaaaagaaataaaagccatccaaactggggaaagcaaaaagtaaacatctctgtttgccaatgatatgatattatatgtagaaaatcctaaagattactggattttacacacacatattcacacacacacagagttaaaaaaaataaattcagtaaagtagcaggatacaaagtcacacacaaaaatcagttgcatttatatacactcagatgaacaatctgaaaatgaaattaagaaaacaatttcatttacaataatatataaaaagaaataaaatactttgaaattaacttagccaagaaggggaagggaaagatttgtacaaagagacctataaaacattgctgaaaaaagaattaaacaaatatatctcatgttcatggtttggaagatttaatatcattaagatatcagtactacccaaaacgatctacagattcaatgtaatccttatcaaaatcccaatgactccttctgcagaaatagaaaaactcatcctaaaattcatatggaatttcaaaggaccccaaatagctaaaacaatcctgaaaaatatggggaaaaaagactcacacttcttgatttcaaaacttactacaatactacagtaatcaaaacagtctggtacaggcatagacagacatataggccaaaggaatagaagaaagagtccagaaataaaacccaaattattttcaaaaaagttatcaaggccatttaatgggaaaaacacagtctttacaacaaatggtgctgggaagctggatatccacatgcaaaataataaaattggatctttaccgaacgccatatacaaaaattaacttgaaatggatccattacctaaatgtaaaagctaaaactataaaactcttacaagaaagcatggcaataacttcaagacattggatctggcaatgattccaaaggtacaaacaaattttaaaaaatataattaataatactgaaatatacacttaaaatggataagatagtaaatgttatgttatgtaagatttacaacaataaaaataatttggagaaaatacctctaagtaacccacagatcaaaggggaagtcataagagaaatagggagacattttgttaaaaatgtgtagattgtattttttagaaaagttttacatgaaaaaaaaatgagcacttagaattcccatatatcccctgccaaagtttcacttattattaatgttttacatttggatggtacattcattagtattgaaccaatattgatacatttttgttaactaaagtccatcctgtattttggttttcttagatttccttaatatctttttactgtttcaggagcccatctaggataaaacattacatttagttgtcaagtctccttgggcaacttttggctatgatggcttctcagattttccttgtttttgatgaccttgataggtttgaagagtactggccaggtgtattcttcaatgccttactattgaaatttgtctaattttttctcatgattaagactggggttatgggttttcaggaataagatcacagaggtagagtgccatatttatccatagtatcaagggtatattatatcaacatgatgtatgacagttgatggtgaccttgatcacatggctgcagtagtgtttattaggtttctctactatgcagttattctttgtactcctctggccatactgtactctttgaaagaaagtcaatatgtgcaacccacacttaagaggtgggaaattatgatccacttcctttaaaattgaatattaacgtaatttatcaggaattcttctgcatgggagatttgtctcttcttccccatttattaacatatttaatcatttatttatatcagtatgaactcatggatgatgattttatacttcatactataatccactgctacattagattgttgttcaaattgttccaccttttgctacttagaatgagaaaacattataaattgaatgaaaataaaaacacctcaaaatgtgtgggatgcaactaaagcagtacttacaggaagatttgttgtattaaatacttgtactactgttgtccctctgtatttgcaaggaattggttccaggacctcccacagataccaaaatcctcagatgctcaagtcctttacacaaaatagcatagtatttgcatataatctaagcacaccctctctctcaaatactttaaatcatatctagattacttataatacctaatacaacataaatgccatgtaaatagttgttatatttttaaaatttgtaattttttgttgttgtattgttatctttgttcctaaaatatctttgatccatagttggttgaatttgtagatgcagaatctacagataaggagggccagttgtatttatgaaaaagaaatatatcaataatctaagtttccaccttaataaattaagaaaagataaaataaaatccaaagcaagaaggaaaaaggaaataataaagagcagaaatcaatgaaattgaaatcaatgagaaagtaagggaaactaaaagctagttcttggaaaatatcaatagaattgatacagtctctagccaaactgatcaagaaacacagaacaaagacacattttatgaaattgaaaaaaaagagaggtgatcagttaagataagacatcaaaaagttaatgagggaatattacaaacaactctagtcccataagttagacaatttacatgaatgggacaaattcactgaaaaatacaaactgccaaagctcattaaaaaaaagagagacacctaaatagtcctatatcaattaaataaattgaatattgttatgggctgaattgtggcccatatgtggccgtatttggagacagggtttataaagaggtgattaagttaaaatgaagtcattagaatagcccttaacgtaatataactgatatccttataagaagagattaagacacagatatacacagtgggaagaccatgtgaagacacagaggaaagacggccatctgcaagtcaaggagagaggcctcagaagaaatcaactttgctgacatcttgatgtttgactgctagcccacagaactgtaagatccattcttggatattttgttataaaagcacccccccaaaaaaaaaaaaaactaaaaactaaaaactaacacaaatatgtatttagaaacctcacaaattctgggtccagttggcctcactggtgaattttagcaaacatttaaggaagcaatactaccaattttatacaaacttttccagaatattgaagaggagaaaacacttcccaaataattttataagggaagcattactctgatactaaaaccggaaaaagatatcacaaaaaaagaaaattacagatgaatatctgtcatgaacataaacacaaaaaaagtcttcaggaaaatactagcaaatcaaatcgtaaaacataaaaacaatattacaccatcacaaagttgggcttatcccaggaatgcaaagcaggtgagatatttggaaatcaaccaaagtaactcatggtatatcaacaggcaaaaaaaagaaaaactatatgatgatctgaatagatgcagaaaaagcatttaacaaaagtaagagtccattcataataactccgggaaactaggataataggaaggctcccttaatctgataaatggcattcacaaaaatactacagcgaacattatactttatgatgaaaaacagaatgctttctccctaaaatggagaatctggaaaggatgtccactccctttcctcttattcaacattgaaccaaaagtcctagcgaatgcaataagttagtaagtcaaaaaaaaaaagaaagaaagaaagaaagaaaagaaatgaaaggcatatacattggaaaggtagaaaaataaaactgtgtttattcaccaacatgagtatctacttaaaaaaattccaaaaaatatatttaaaaggccctagaattaatgagcatttaggaaggttgaaggacacattggtaatatacaaaaatcaatcatatttctatctactatcaatgaacaatagaagttaaaatatttttcataagtctcatttacaatagcaccaaaacatgtgaaatattagatataaatctaacaaaacatatatacaatctatatgttaagactgcaaaacaaacaaacactgatgaaagaaatcaatgcagacctaaacagagtgaggaatgcttccgtcaggagaaacaacaacaaatccgttaaagtggaatttgagaacgccaccaggacattttgggttcctcatatgctactgaatcatcagggaaagggggattactacactgcctagtgtgctggattccaagtattaaggggaaactgggctgctgctttccaatggagtaacgaggaatacgtctgcaatgcaggtgatcctctagggtgtgtcaaggtgattaagtaaacagaaaactagaaccacccaatttaggcagaactactaatgacttagatcttgaggaatgaatgtgtgggtcaccctatcagacaaggaaccacaaccaaatgggatgtttgctgagctgaaagagaataccagacaggtgtaagacggcagtgatcaaaaccagatacaaccatgtgaccagctgcataaacagggataaaatattgtgaatttttctttcttttttgatatgcatattttatacatatatatatatcatatttttgttttcttttaaaaatattaaagggaatgtgaatcagttggaaaagaaagaatatcactcaagacaaaaaagagacacttttggagaaggggagagaatgttttcagttgtacacagattagttttatcactgtagatgcaagcataaggttgtccttatttggatattaagtaacatttaaaagggtgtatataggtgccaggctgatacagggtgaactgtgatagctttataatatgttgacatggctaggctggaccacttttcccagaattctgttctctgaatgtttccagctaaaacagggcacaagcgaggttctcatgtcagatctggaaggtgaacatggggcagcagctattctgtgctcagatgcactatggatgatctcctgactcccctcattctatatgtggaaggaagaacttaaaatcacaacagtgccaatcctacctgaatgaatataactggcatgtcattctatctaaatttcaaacaagtttacacaggaatgaacaaaataatttaaaatcaccgatgcagcaaaaacttgcccaaatagctacaaaaatgtattttttaaaaaattagagggaggattttcctttccagatatatttagaataagtagaatcaaaacagaataatataatatgtccacaggaacaaacaagtcagttagtgaaaaaaaatttagagaatacaaaaggatcaaacatttttggaaacttaatatgtgataaaagtatatataaattcatttgggaaatgtggtttacttagtgaatagtgctggtataactgtccagtcatatgaaagaaaatatagttttctatacccctataatatttagcaataaactgcagatagattcgtgatctaagcaaaataagtgaataaaaattctgaagaaaatttaggagaatatttgcatgtttttcctgtaaagaagacctttttaaacattttagaagttaagaatgttcatgaaagtctcccttcttaaggtatagaattgagggttacaatttatagcacatttgtcagacagacaacatgttaagatttccaacatgtgaagagttcctacaaattaataagaaaaacaatgaacaaagtttataaatatgcaaatccaagaagaagttaataaacatatattaagatacttgatcctagctgggcacagtggctcacgcctgtaatcccagcactttgggagaccaagacgggtagatcacaatgtcaggagttcgagaccagcctgaccaacatggggaaacctggactctattaaaaatacaaaaattagccgggcatggtggctaagcttttggaaaggaatctggtattgcccattaaaatataaaacgaacataaactttgacttaactatcttactttagggaatctaaccaaaatcaaagtaccagtacttaggaaatacgtgtaaatatatatattgcagaaaaagtcaactggagaatgggtgaatatattatggtatttccatacaatgaaatattagacaactattaatcctatgtcagaatatgtcttaacctatataataatatagtttaaattttaaaaactatggttgcagggtaattgtagagttgcagagcacacatcaatttttatttaaactttaaacagaaaatctgtttttatatctttgtgtattcttagataaactattatattggttgcctctgaaccaggattcaggatgatgggaggaaattattaactttttctctatatcattctatattgattttcactaaaatattagcatacattaactttataatttaattttttaaaattttggcttttaaaatattttattaaatgttaaataggtacaaaataataattaagtaaaatatctttaagaacaatacatacccaatttaaaacagaacattagcccctgatgctcctgtgtccccttcccagacctcattccttgtcctcctccctcagggaataatcactattctgaattgtactatcattccttttgtttgttttgtttaccctttatgctgttttgcatatttcacaaatttatatagattacattattttgttttaaatcttgacttttttgctaagactgcatctgggtttattcatcttcacattaaacaaaatacaatatctaattcatacatgctggtgttgacagatatctgagttgtttacagttgaagtctattaaaaacaagcctagtatggacattcttgcatatgtcttctggtagaaaaaggaaagagtttctctaagctaaataaccaggaaggaaattgctaggacatatggcatgtgcacactaaaaaaataccaaattattttccaaaatggtttccatcaagccacatactcaccaatatcaactattatcacatttttaaaaatggaaacaatctagtcagtgtaaattattatttcactatgatttaattttcacttccctgattcgaaattaggttggaccactttttcatattttctcttctgtgaaatgtttgttaatgtgttttgcccatttttctatttggttatcttttacttactaatatgcagtttcttatattttctaggcattaatcctttgtgagcatagacctcagtaacagaccctaggaggagcctaaccatagtcctaaactgaaactgaaaaggagggtactaagaaagaaaaaagcagtgtctatctacttttccctaggaactggccttactctaacagctaagaaatggtatttcctgtttgcaaagtaatgtgttcttatttttattttaaaaatatatttatattcaaaattccacttctgcctaaatatagaaagctagtatgagcatcactcctaccctaacaatatacataagttgaaaaaaaaacactaaatcaaaattttattgaacccattagagagctgaggttgcagggcaaccaagtagtctgcaatctaaggaaagacagactctcctaaggagtgacaggacatgaacactggctccctgtggcagttcaagggagaaagagataccaggcactatacaaatgggaaagaagtattcagacataaaatgtaatgcactgctgatagctggatgtgggccagtgtgacagtacagaacagcgtaaagccacagacacaaaaagaacttgcacacattcacagactcaagttcacagacctccaacaggtgctcataagaaagactgagagcagagcaggaaacgggaagaaccattccctcagaagggtaggcttggaggaggggagccactgtcatggtcgaaaatgcgtaaagccccacttagacctatttctcccagaacaaaagccttacactgcaggaggaggagcagcaatccctgctttgtataagtgtatacccactgcagttggaaacagagcaaacaaaatccatctattcctggagaaggtgcagaaaacagtcctaagcccaggatttaatgccattattattacaaaactcctaccactacactaagtgaaggggaggaaaccttctccactgtagacttgccaaaggtgtcaggcagagtctggatgccatgagaaggggtagtatcactaaccaagcctgtcactgaggaccagggacagaggacctgcccaaggctgagaatggaataggacaacaaagaatgacttggccctccctccccaggcacgcaagcaccagtctactgctggaagataggcaggagaaggaaagaaagcccttctaaagcacaggcacacaggggaggcctaaagctgaggacgaaacaggaagagaccaaaaataaaaactccttagcaccccagctgacaccctgcgcacaagctaaatcctaaggaattctaagccaatggttcaccataggtaatgagagcaacacaaaaccaaaacccagctcatgtcctaaatggcctaccagaggaataggcatgactatttctaggcataaattctatttactttagtctctttttttctacacccagtaccaacactcaatcagatatatagacacataatgaagctgcagcagctgcaacaacagaagccagtgtcaaaaagcaaagcaatcacagaaaaaaatatcagcaacaacccatctgtcagagttatccaccagggaattttaaataactatcattaacatgttaagctctatgaaaaatgcaaacaaaacgcattaacaacagagacggaatctgtaagaaggtgtcaaatggaaatgttgtacataaaaaacactgtgtgctttcaatgggttcattagtagacttgacacaaccaagaaaggaatcagtaaacttgaagaaaggttgacagaaattacctaactgaaatacaaagagtaagaagagtaggagaaaagaaaagtaaaaagcaacaaataatgttagtacagcttctttggaatacagtttgtctgttatacacttatgacccagcaatcccactcctagatatttaccttaaagtaatggaaacttatgtttacacaaagtttgtgaatatctgtagtacttttatccataattgccaaaatctggaaacaacccagtgtccttcaactggtgaatggaatactattcaataaaaaagaaattaaatactgataaatgcaatgacacagatgaatatcaaaagaattatgctaagtgaaagaagttggactcaaaaggctacatatttatgattccatttatacaataccttgaaaaagacaaaagtaaagagaatgaaaatagattactggttgctaggcaccggtggtagggtaaagggttaactataaaaaaatacaagagaaatttggggggagatagaaatgtactataccttgattgtgatggtaaaccttggtcaaacctcatagaactgtatgctaaaagggtgaattttactgtatgcctcagtttaattaagcatgttttaattaattaaaaattatgtctcgttttataaaagcatattcttataaactatttttgtaggagatctgcattttaataattgcataaggtgatattttcttaactggatttgacatttttcaaataaagtcattagagaagatgtttccaacatttgatgggatgttggttatggatgacctctaagatcctctccaactccaaggtttttgaggtgtgcatgtgatcccccaagtttacaaacacaaattttataaatatatatatatatatatacacatacacatatatgttaagtatatattcatagttctaattacatttatattatatatacatgtaaatacgtatacacaaaaagttctgaaatattcttcagtattataatttattatatatttgttattttctttttttccactataaacatgtgataatttgtaatccaaaaatgttattattttacttacaaagcatatattgtgcaacaaatttttaaaaaggaaataaggaagcaggttatttttcaaatctataaaatacctagctttaaaaaaatggattttactaaactgacatatttaatactttaaaatacttgaagaaaggacaggaattagccattgtgaatatggggtgtggagcatttttttaattgcatttttttatttttaaaagaaaatcctagaaaaccatattttcccatttttgaagttttccctagctctttctttcatttgtattagaaatatctttgtgcatatctctaaaatagagcctcaacttgctactacaaataggatgatgtcataccagaaagtagaggggagagagcctgtgatggccctgcagcctcctcatcctcactgctccacctgtctcttctgaaggggcctctggctgtccacatgctgggatcactgccactagaaaagaaatgtatatatttgcccatggtttcaaagaatatatacatttgagaaatactttctaatcatcttcattgattatttaattgacattcatttccatttcaattcagccacccactcccattgtcatcacctgaaactggcccacttgtgaaataattcccaaatcccaatatctgatcacaaactccatctcctcctactacttttaccttgcaaactagtcgcctcagatccatccacttatttaccttctcccctcctttacctagactgtgggagggaagtactcgggtcactgggctttctaatatcggcagagagccgtttggaaaataccagcatgtccctggttggtttcctgtaccactcttccatggcagcaaattccaagccaccatcttgttatagtccttattttaatactctctctgacttagtaaaaatgtaacttcttctagaaaatgcaagccagaaaatagaaattctttcaatttattatcttttaaaacatttacttagatgcatcaatgtctttcttattccttgctttctgcctgttcaaaattcctccttccgtgttcttaaccagattccttctgcctcctctaaggtatttttctataacttatttttttttaacatatcgtgaatttctccctatctacaaattctttcatatcataagaatacacaattttctgtatcttaaaaataggaaatgctttaaactctgtctagctactaattgttaacagatttttcaaatcctagcccatacccactttgtttcctttgcaacgtctccatactcaactgactcgctaatgctattaacttggctcttgttgcactttcatttgcaaccctacctagcaaaatcctcctaatttgacttctgcatctaaccttcaatgtttagagaaaattcttcctaaaatacaaacttaattacacctgcccaccaatatcaggataaatcaaggccccttatcagacacaaaagtttaggatattggccaggtggcctctgtctatttttccatcaccatctccactgatttcctacatgcactgtatgctttaaccttagcaaaataagtgcctttttcttttacttctgtaagaaaattcgggtttcttactcttttctccttctaatttttttcttggattactgtaaacatttaattaatctccactgactgccacttccagctatcctcaccttgccaccagcattcctccttctggatggataaatagatagttgcatgaataaaacaaaaagaccctccgtatgcatccttttgattttaacagactgaataaaatgtatactcagcttcacatatatggcattacttccctctccagcccacactgtattttgggctccacctctcatcttctgcagcttcctagcattccacctcacatacaccctacgactcttggcacctaatatttctccccattacccctaagatattttcacaactccttaccctcgctcaaacttctccctcttgcctgaaatgttcttctctttttcacctgctaggtttctatttaattaaatcctaaattcaaccaaaatatcttttcttcaaagaagcttgtgggaaacctccctcatgcatagtcaatcttctgtacccacaatctttggatttttactctaaaataatatttactatgttgtacatcaatttgtcttttatatgtctgtttccctaattaaactgtgaactaaagagcaaaaaatatatagtagtttgtatttgtgtacagtgcttagtgtatcacagaatctcaaaatgtctttggaattactattatttgtttaatgcacttctgaaaattgtacatataaatttcatacaatacgcatacaaaaacacataatataaagaatatacacattcttatacagtgctattccagtgagggtagctaatattactgataaatctctaagaaaatatggcttaacaaaatgtttcctcatttgatgtttttgcttataacacctaaatttgaacattttataagcatgaaaacttgtttctttgttttcctaatggaaatttactgttcttcaggtactttaaattttttaaatatatactaccagaaattcaccatactaataaacctgttgtttataccatataattttctttctgaaaacagattacatttctaataacatttagtgctgtaccgtgagcttcatgctacctcaagtacactgaccacttcaaaagctccaagcatatttgcaaaagctttgacgccatgtaactattgagaggatagagaaatcgaatccttcaagaatacttttcccttatgttaattaccatatttttgagatcataaacatatttctaagaaagctaaatcaagtttataaaaagctatatcttgaaaaattaaacatttcagggccattattcactgtctccatgcagagggctagctatgaatataagtagcataaacagaaaacccactaaataagcatattagttatacctttctgaaggctcttcaaaaacatcctcataatcattatgtgggaaattccgaagagaaagttttaccttctctgaattaactttattttcaaaaacctacagacataagaaaggaaacaaattatagcactggttttagaaaaatatggtttaaaacgtgatttctatagctacttaagaagagcaaaaagatctgcaataatggaattataaccacaatcacatagtataatgtctgctcctagaaaatcacttaattgtatatctccctattaaatatcttccaatctgtcaaaacagtgtagagtactatgtaaacagaagttatttatattgaattgctcaagtgatttttcaaaactaaatttttaaaaagcttcatttgagaaaaaatagatttattacttcagcccagaagagattttcttataagtgtttaccatgttttgtttactgtgaatataaaattcctgccactaaatttatctttactttagtacttgcaccatctaatctactaattctaagtatttctccacattccactgcccaattttgcaccgggcagtggacttcagtcttgataactcgcagtgccagtgccccagccaccacatacacgtttccttccttccttgtctaatactgtcttgccatacttggccttctattttctcaagaacatcttttgaatcagctgatcaaatctcattcacacacagaaataactttgggactattattgaaattaagtaatatgaattttttaatttaaattggaaataagtgatgtatttatatattaagtatcattatccactaatatgatatagctatccagcaaaaagattataaaatattctcaataaagacaatgtataccttttcttagatttactcctaaacaccttaagtggcacaattgtaaatgtaatgtcatagagcagaccttttatttgatacacactgctcaatccacaaaccacatgtttttacatctagtatttttgtgtacattccattctaaatactttaaacttccattatgatttcttctttgactaatgagtttgttagtgtttgcttggtgtatgtttaatttttactttaaaatcacaggaaaatgtccacctaagattccttctcattaaactatgtagctacaatacacgaaatgaaatgagcttcacagaattgaactagttttgaaatcagcactgattggcaaatccctaaaaattaatttcaggataattaaaattgaaatgtagaaagtgtggctccagtgggatggaggaaaagaagtgggacacatgctattacacaacatgatcccacttccctcttacgagacatgcttaaaagtcatttgagtacaattcatttacttagaaaaagtgatatctggaagtcctaacacaatttaaacctgagacatctttcagctcatggttcaaaatcaaatggattatatttattttttaaagaagcagactgttccagatggctgcaattcaaatttaaggctgactaacatatgtctgattgagtgaaaagtgattttgctaacaataccaagaactaacaaggagaaatataataaattatcaagatggcaggacttttggagattgctcacggaatcaaattaatatcaaattttttaaatgttagaaaatgttttctgaggagcctaagttagcttttctgtagtccatgcagcaaggatttatgaggacaaagtgaaaacagtaacacagataggagcctggtttctagtctgtgactcaagagttatatgatcatagacaaatcgcttcagctttcacctctaaaatgagtgctggcataaaaatgtctttaacaggccaggtgtagtggcttatgcctataatcccagcactttgggaggccaagacgggtggatcacctgaggccaggagctcaagaccagcctggccaacgtggtgaaaccccgtctctaccaaaaatccaaaaaataaattagcctgtctcaaaaaaaaaatttctttatgctccaaatctaaccaacttcaagtctatgagtctagacaatttctaggggacagcatcatatctgaaaggacataaaaatggctacagtatcaaattgtttcatgaaacataagaaaagcaagttctaataaaatcaggtaattttcccaacactataaaaaccatccaggaatgttctaagatccttttttatgaaaggaaactttaaagcatatcagaattcaccctagataggccaagctataacttagcaaaaaaacaaacaaacaagcaaaaaaaaacccaaagtaaaaatataaacaaaatcacaaaatgtgctcagttctagaagaagtcaaataagactataagactatataaaggatatacttgggccattctgtgaaggtgctccctttcaaatcgtctctgcttcaaagagaaaaccattctgatcagagaaaagaatcaagagtgagcggagagcccaacacggcactaacagccagagattcccagccaaagatgtgatggtagccttgatgtggccaacttaagtatagcagagaatggacaggagataataatcaagttacaacactgttcttaaaagctgcactcctgcccacctggggtggaggtggcaattgaacaggggaagtggtaggagcagtttttggtctatgtactgactttatctctattactcctgtaacttacaggaaatgaacacaaggccagcatcatcatcgcagttccaaagctccagttgactaggtaagagaaaaaaaaatgcaaagcacccaccagactaaaatgcatttccctttttttgtgctctaaccctagcactatctccacaaatggggtaatgtgttgaagtaagaggttttgtcacagacttttcacagccctctacttttccatagttcggagacacccaatcatgctgtctcaaacaatgaaaaagtccacaatcaatacatctaaaggtgcttcatacttcatgtgacatttattttgtatcttcattagtaacacaaaactagtgcctgtaaaatttccagagtagcattagaaaatgcaattcattagaaactttgcaaaaaattccactctttcaaatccccattttggtcactgtcaacactacagtgacaaaaaattaagaaatcattttggtgagaaccaaatagatacccatttcccagagagcacagtcagcaatttaggtattagccaaaattagtagagatccctctccttttagtcttacctttgatctaggtgtgttttcctgacttgatgaaggcaaagtctccctgaaattcaagtcttctgcttcagagtcatttccctcataatcgtttactgaacaaaggcggggggaaaaactgatcaaatagaaaacactatacagaaggaaaaatggagccttaatgagaaaaaacaagctacatgaggggcattttcatctacttttcctgttttccaaacaccccatctttatctcctatggtaatcatctctttctcccctgctttgaaaaaatcaacatagcaaagctgatccttcttctaggattatcctcagggagttgacttttgagcggttcccttgttcctcattgccatattattcaagaaagtactcttcaagtaaatcctagatatttacaacctgcagaacctatgcattgggatctacagaatacagtcttctgtgtttcagagtctatttcttgaataaagaatactgtgttacaaatgtcgcactgtaacttcttgtattatttataattcataagttagtaatatgttaaattatacagaaaattgttttcggctttgttgaataatgtaatatgaatcatcccaaggaaactctgggtttcttatatgattattcctaattactgtgttaattttactgcacagactctttcagataagaagccaagagaaaattttctctgatctcagtactgagcactcagagtactgtttctcataccatgggagccttaaatattatgatttagaaattctatggcatggcatattaccaaatcaataaaaatatagtaaacaagtactatggaaatgaaaaagtgtgttcctgaatgtgtgttaaaaaggaaatctaatagaaattatgaacctttataacacatgaattaattttataaattaaaacattaagaaatatcaatgaagggacaacatatcaaaactaatgtgaagtagctaaatgagtatttagatagagggaaaatgtataggtttaaatgtgtttacaaaaaaggcagaaaaaaaaagctgctataaatgagttttgtattcaatcatagaagccaaagaaaaactgaggaaacccagagaaactacaaaggagaaaatcataaagaaaaatataataacagaaaataagcctaaagaataatcagcaaaatccaataaactagttctttgaaaaaaaaaacttaaaaatacgcaaccctctttcactacaaatcaatggagagtaagtgcacaaataacattaaaaatgaaaaaggatcgcttctcggccttttggctaagatcaagtgtaaaaatgagaaagggcacagctacagatgcaactctcatttttaaaggtaataagcaaatattatgagaaactttagggaaatctgatgaaatggaaacttttataagagaattataagttatgcaaatttactccagaagatgtagaaagcctaaatagtgtaataaccatttaaaaagtcaaaccaataatcaaaaatatcactcccaagaggaaaaagcatctgggcccaaacaggtttccagatgggattttatcagactttcaatgaaaaaaatctctcatgcaaacggttctgaaaataggaaattccgcaaacctaggaaggagcttcaagtgctagaaaaaaaattaacaggaaaaaaaagtctatgagaattgtaaacaagcaactcatagaaggcgacttacaggccaataatatattcagaaaaagtccagcctcacctgacaaacaaaaaatgaaaagtaaaacaacctacaattgactttcatttatgcttatgagagatttactgtaataggacttaaccacaaccaaccagaaaataggacaaaatatataaaacaataattttcagaccttaaacaacagactgtgatcccagagagaagggggtgagccttctggttgctccagattatggcctccagaagtttgcaggctatagctcaggaaaggaatcaacgagtccagtgattcaatgagttgagaagaaaaagatcaaagttaggagaggctgaggcagccagaatttgtagggcagagtaccagggaggagggagctatacagaacaagagaagtctaagtagctgcaaagaaaccctctcatgtcctttgcagaatatggatatgcttatatgaaggaggacaatctctgacactcaggaaggaccaccggaaagtagcaagccacacaattcctaggaacagttcataggagccagaatgaggagaccctgtaatacagggggcgttgaggatagtgcacagaagagatacctcttagtactaaaactatccttggaacagaagctccttagggccacctataaaaaaggtgaagagcaagcctcagacaggatcaggttaaacttcaagtaacataactacaaggcagaaaaacccaacattctttaaagaaaaatcaaggccgggtgtggtggctcacgcctgtaatcccagcactttgggaggctgaagagggtggatcacgaggtcaggagttcgagatcagcctgacaaacatggtgaaaccccatctctactaaaaatacaaaaattagctgggcatggtggtgcgcacctgcaatcccagctactcaggaggctgaggcaggagaatcacttgaacccaggaggcagaaggttgcagtgagccaagattgcaccactgcactccagcctatgagacagagtgagactctgtctaagaaaaaaaaaaaaaaaagaaaagaaaaagaaaaaagaagaaaaaaagaaaagaaaaagaaaaaatccagcaccaaaatcatataattcacaatgtgtagtaaacaattaacaggtatgccaaggaatagaaaagtataacccacagccaaatcaatcaatcaatagaaatgtacttagaaatgacagatgataaaatttagaaaaaagaacttttaactattataaatttttaaaaggtgctcaaggaaataaagaaaaacatgatacaataaaaagagatataaatcatgtaaaaataagacctactgaaatttctagagacaatgtatgaactaaaataaattaacagcagataaggcagaaggaaaaaaaatcagtgtctgtcaacatacagcaagagtatatccaaaatgaagcgcacagtagcgaaaaaaagagactgaacagactcagcaaactgggacaacatcaagtgaactaaaattcctgtaactggaatgccaaaacaaatatgaagaaataatagctgaagtgttaccaaactagatgaaaactataaaccaacagaccaaagaaggtcaataaaatacaaatgtaatatatgagcttatagaaaaatcacattcatgtatgtcatattcaaattactgaaaagaaaaaatgccagagaaaacagacacattaaatatagaaaaacaaagataagaatgatggatttctcatcagaaatcatgcatgctagaagataatggtgagacattttaaagtattgaaagaacatagaattcttatagaatgtcaatatagaattctataccctgaaaatatatatttcaaaaaataagacttctgtagaccaataaaaactaagattatatccagcctgcactaaacaacaacaacaaaagttaaaggaagtttttcaggcacaaggaaaaggataaaatatgaaaatgtagaactatccaaaggaatgaagagtggcaaaactggaaaatacatgagcacataaaacatactctttcacatgttctaatttctttaaaagataactcaattataaggaaaaataataatctattgtagggtatacaacactcacaataaaattggtatcaataatagcatgaaaggcaaatgggaggaaatggaagtatcttatgttcctacaactatatgtgaaatggtaaagcagttcccgcttacccacagggaatgcctagttccaagacccccagtggatgccgaaaacttaggatagtacttcctgcactgaagtcttaaatccctcaaagtcatccatgagggttaaaatcagtttttcccaaactcccattaatgttgacattttgacctcctcccataaaccacaaatgttcttaatggcgtctagaatggggagttatttccaaaaggttttcaatttactttgcccagagccatcagaagaatcactatctatggcagctacagccttacaaaatgtttcttaaataatgagacatgaaactcaaaattactcattgatttctaggctatggaatagatactaaatcaggaactaactcagtaatttaaaaaaacctaccaatcagaaagagcccgggccagaaggattcacagtcaaattctaccagatgtataaacaagaggtggtaccaatcctactgaaactatttcaaataattaggaagagggactcctccctatctcattccataaggccagcatcgttctgataccaaaacctggcagaacacatggtctaatatccagaacttataatgaacttataaatgaacaagcaagaatcaaacaaccccgttaaaaaatgggcaaaggacatgaacagacacttttcaaaaggagacatacacatagccaagaagcatatgaaaaaatgctcaatatcactaatcatcagagaaatgcaaatgaaaaccacaatgagataccatcttacacaagccagaaaggctattattaaaaagtaaaaattaaaaaaaaaatgtttgtgaggttacagagaaaagggaacacttatacactgctgatgggaatttaagttcaaccactgtggaatgtggtttggagatttctcaatgaacataaaacagaactaccatttgattcagcaatcacatcactggctatatgaagggatataaattgttccgtcataaagacatatgcacatgtatgttcatcacagaacttttcacaatagcaaagacatggaatcaacctacatgcctgtcaacagtggaatggataaagaaaatgtggtgcaaaaacaccatggactattacacaaccataaaaagaatgaaatcatggctgggtgcggcggctcatgcctgtaatcccagcagtttgggaggccaaggcggatgaattacctgaggtcaggagtttgagaccagcctggccaacatgatgaaaccctgtctctactaaaaatacaaaaattagccgggcatggtggcacacgcctgtaatcccagctactcgggaggctgaggcagaagaattgcttgagcctgggagatggaggttgcagtgagccgagatcgtgccactgcactccacctggctgacagagcgagactctgtctcaaacaaaaacaacaacaacaacaataaaaaaaaaaaacaaaaaacagaatgaaatcatgtcctttgctgcaacatggatgtagctggaggccattatcttaagtgaatcactacctgggtgatgagatcatttgttcaccaaaccacagcaacaagcaatttgcccatgtaacaaaccttcctatgtacccccaagcctaaaataaaagttggaaagaactagtctacaaaaaagtttgggtagctttccatgtttttgcatattctagcttaactgatttatcattaaaattagctttttcataaaagtttgcaactgttaaaggatagtttccagaaaaagaaaatcacagctctcatacagacatataaatgcacatgttactttattatattcattaatcagtgagggaatcaggcagatgttatttttaaatttttttttaaaaaacccataatactgtgtgttagtctgttagcatcactacgtaggaatgtctaaggctgggtaatttataaagaaaagaggtttgttctggctcgtggttctgcaggctgtacaggaagcatggtgctggtatctgcttctagtatctaacctcaggaggcttatagtcatggcaaaaagtgaatgaggagccagcaaatcacatggtgagagacaaagcaagagagaaggggaggttccagactcctttgaacaatcagatctcacatgaactgagagagcactcactcatcaccagggggataacaccaagccattcacgaaggatctgcccctatgatccaacatctcccaccaggttggggattacctttcaacatgattagaagagataaacatccaaactataccatacaggaagtccttgccagagcaattaggcaagagaaacaaacaaaaggcatccagattgaaaagaaggaacaattaggcaacagaaacaaataaaaggtagccaaattgaaaaggaggaagtcaaatttgtccctgtttagagatgacatgctcttacaaatgcaaaaacctgaagaatccaccaaaaaactcttagaactgataaacaaattaagtaaagttgcaggatacaaaatcaacatgcaaaaatcagtagcatttctataaaacaataacaaactacctgaaaaagaaatcaagtaagcaatctcatttacaataactacaaaaaataatacctaggaataaatttaaccagagattaaagatctctagaataagaactataaaaaattgatgaaataaattgaggaagacacaaaccaatggaaagacatctcatgttcatggaataaaagaataaatatttttaaaatgacaatataaccaaagaatctgagagctcaatgcaattcctatcaaaataccaatgacattcttcagagaaattttaaaatcataaaattcatatggaagtacaaaaaatactccaaatagccaaagcaattctgagccaagaaaaacaaaaacaaaataaaaacaaacaaacaacaacaacaaaaaaacaagaacaaagcttggggtattacactacctgacttcaaaatacactacaaatctatagtaaccacaaaatcatgatactggtataaaaacagacacatataccagtggaatagaatagagaacccagaaataattccatatgtttatagccaactcttttatgacaaggcacaaagaacatatattggggacaagaaagtctcttctataaatggtcctggaaaaaactggatattcctatgcagaataaacttagactcctatccctcatcttacacataatctgacttacagatggaatccaggctcacaaaagcagatagcagaatggtggtttccaggggatagaggaaggaggaaatggggagttgttggtcagatggtatcaagtaacagttacacaagatgaatacgttctgaagatctgatgtatagcaaaatacatacaatactgtattgtaatgatatttgctaagagggtagatcttatgtttgtaatacacacatacacacaaagaaagaaaatggtaactgtgaggtggtggatatgttagcttaattgtggtaatcatttcacagtatatagacaaatcaaaacatcaagttgcacaccttatgtatacacaatttttgtcaattatacccgataaggattggaaaaacacttctagggagagagcaataataatgacaaggagggcggatagaagagggaatagaagctgggctgaaggtggaaggaatgagaaaaggcataaaagacatactgaaaaatgatggcaagctactaatgttttaagcaagacaatggcaatatgggtcggctgggagacagctgacatttaactaaaacactgcattagtagatgtatcaaaaaccttagaaatgtatatgccctgagttcacagctaacaaaattatggaaacaaacagctttgtggcagattacaggttgtttttattgtcttgttgttttctttgtgttttggtgcttttttgtacttcccaaattcttcacaataaacctatattacatttataatcaggaaaaaaaaatgccatttgaaaagggtaaagtaaaacactagagtttaattgttgttactctaagcgtgatggcttattagaaatgcagagtcttgccccccaccccaccccaccaagacccagaggatcagaatatgcaggataataatccacaggtggtccctatgcaaatctacagtctgagaggcactcctgtagctcctcctgatcccatacccacaaaagtagatgatgcacctaccaggctctgctctaaagtccctaggtgaagacatgttgttcccatcccctaaatgagactggtaaaaggcttcttcagaaaaggagccttagtgtcctgtgagtcaggccaaaggtctagttagtatcctgggggccagcaaacaatttttgttcacctggtaaaacacacaaagccaaagatttttctgttacacaactggagctatcacagctttgacatattattactcatcaattcaaaatatttaaaactgcaattttaattaaagacaaaataaatttcatttgaaattttatcaaataatttcaggatattccttgagaactggagatacgcttatttattcaaataccagagcttaaatatgctataccttgcattccacaaataaatatgtgaatggcccctccactccaatgatgtatctctttatataaacacacacacacacacacacacacacaaattcaatcaatgtcactcaatggaaactcagttatttaaatgccacacctaagctaaattaggtgctgagaattcagtactgaataaataagaattaattacagagaccgtcttcaaggagttcttgttcattcaatctataaaaagttctcacacagaataaatcttttttcttttctaattcttgccataaagggcctgtaaggccatgttacattgctcccattggttaaaaccaagaatacttttatctggagacctttccattaactacctgcaaataaaatggtattactataatctgaatctaaagttaatgtgtgaaacagatttattttaaaaactttgagatataggtgttaaaaaattatttaagactaggtgtagtggctcatgcctacaatcctagcactttgggaggccaaggcaggaggatcgcttgagctcaggagtttgagaccagctggggcaattgggtgaaaccctgtctctacaaaaattagacgggtgtggtggcacacacctgtggtcccagctacttgaaaagctgaggtaggagaatggcttgagcctgggaggaggatacagtgagccaagatcatgccactgcagtctagcctgggcaacagagccagaccctgtggcagaaaaaataaaattaaattaaattaaaatgtgaaagtaaggcaaaagataagtggaatgtcacttcaatgtcataaaataatgacaggccatcccaaagattacttatgtggggaaattgtactttattcagttcattgtttactactgattaaaagtcctagacttaatgcaattacaacgtaacctatagatttttgtccagcagtgatacaaataatttctgtctgataaggtaacactaaagattataatttatttctgtctggcattaaccaggttttcttaatctaatctagcattcttactctaacattggttcaaaacgccagtgaaaaacctagatcctcaaactgttctttgaactacctttgccatcttcctggtttcttcactaattaatacattgagtaaaatgtttaacctggtttcatttcaaatttgtgagtcacatttataatttttaaaaaactctgctttgacaaggggaagaatatcttttttaaataggaggagggctaggcacagtggctcacacccgtaatcccagcactttgggaggccgaggtgggaagatcacttgagctcaagagttcgaggccagcctgagcaacccagtgagacctcatctctaccaaaaattaaaaaaaagaaaaagatagccaggtgtggtggcactcacctgtagtcccagctacttgggcggctaaggcaggaggatcacttgagcccgcaagatggaggctgcaataagctatgattgtgccactgtactccagcctatgcaacagagcaagactctgtctcaattaaaaacaaaaacaaaaggatggcagtgttcttgtgactggcagtgaggtaacagatttcagtaaggagccttccctggaagcagacatgagatcttaaggacctcagaattaactaagaacctctaagaatgacacctaagcttctgcctaccaactatgttattgaaaagatacaaaatagtacaattttaattaaagacaaaataaattttgtttcgaattttatcaagtaatttcaagacactccttgataactggagacactcttactaattcaaatactagggtttaaacatgctataccttgcattccacaaataaatatgtgaatggtcctttaccccaatgacttatcctctttatataaatacacacacatattattaagacctctccagtgcacagatgaatagactaaaattcatatcaaaccataccaatagtcagttgttcaaaccttccatcagaacagctttgatcagaaatgcatgcctaatcctagtattttaataaacaacagtgcagtgagtcacagataaccctacagaagcacaagaattaaactggataaatttccctttcctggcatgttttctagtatatcttaaaatagacaaaacaaagcaatattaaaatcattaacatttaattcaattttgagttgcagctactgtagtaaaccagtaataagatcatacaagtcaacatcaacacatgtgtactgaaattttaggtagcctagaaaagtaaactatatgataaaaacaaaatcttcatttgcagaagaaaacctttcagaaaatatagtgcaagcttttaccatatttcccacctcccctcaagcttggctaagtaagcccctgcaagtgcttcccctataagctccatgttttataatgatttctggactcatctcctcgggttggaccataagcatcttgaggacagaaactgtaacattttcacttttcaatctccagccactagactaacacaatggagacatggcaagaaatgtttgagggactaattagttaaattccataaagaatgtgtatgtatcaccaggtaactaatctgcatgtccacatcaagaactctgagaagtcacagaggtaccacttgagtgataggcactcggtcccttagggaaagattgtgaaagatattgagggaccagtggtcaggttcgtaagataaaggtttccctccaactcctggggaaggtgcaatagtatagaaaatagagaattagccctgataaaagagaaatccttaaaaaagtattacttattctgtgatagagcactgaggaaagaggaacaaaagctccaatatgaaacaaagtgatcccatctaatcataaataaaagaaaaactacaagtgtttggtttgctcaggaaacaaaagcaaaacacctttcctcaggtggcagggtgacataattggagagtcactgaatactgtacatattctcaaattctcagctgggacactattttcagtctatctcaaactctctcaaaactgaagcaggtgctaacaaagactatttcttcacagtggactttgggttgggtgcaagatgccaaaatagacaatgtaaaatgacatgctcagcaccttgggcctctggcaattcttagcaccagggctacttctaattcttgtgaaagttctatcatacactactccctgagacctatactagcctgaagagaagggaatgaaagaagtctcaaatgttcaatagtgacttactcttgccctacctgtaggcaccccagggatatgagttccttcctctgaaatctgtatttcctgtgactaaattctcagtacaagcttcttagactactagtaattatttggcatgttttatgccttttaataatggctcttagttttctataaggaatggtggtattgctttttctgattataaacataaccattaagaaatgtcattccgtggtttcttaatcaatcattccctgtagtgtgtgagtataggactgggggctcagagggaagcagggagaagtgaagtgctaaagtgctacctccagagccactgacagttctgcccaatgcaatcaggcaaaacaagaaaaataaaataaaaggattcatattgggaaggaagaaggaaaaccatctttacttgcaaggttaaaagctttatacataattacacctcaataaagttgacttttaaaaagccacaaaaagataatgtacttaaattaaaataaaatacagaaactctaggataaagataatatcaagttattaatgcaagtttaaacattaaaaaatagttgctacccactcatcacagacatgagcagcaagctcattaaagattactgtgagcattcattggaataatggaagactcaaggttccaaaggcactgagaccctatatcaacaatgcttcacccttgaaacccagggactgatgatgatacagttgccatgagctacattctgagtaaatactttatcaattattagaacggttcaagtaaaagtaatgaatgacttaagacatctttctgaaatgactcttttatctggatgcctctgctattagggtgcaaggcaaacaaccttctactgtttgtttcattcatgatataaattgctttggcatattccctccaacctcctgaacctcaggtcgatctgtttgtccatttgtctgtttacacttcttttcttccctccttcctacgttcctctccctctcttgtggaagtgtatcagtaattataagagggtgctttatttcagaagacacaattcctgtacctccaatcactgttaccaagcaaaagagttcactgttcaatgtgttagaagccaatactatggcactgggtttttgagaaaagaaagacttttttctaggtcaaccaacaaggagacaggagtctagctcaaatctgtcttcctgtactgtttttaaggcagtatttttattagaaaatgtgtagggagtgaatttggggatagtaggagattggtagaaggaaaggggggtctgaaaaggctttgggcatttgcagtatctcttcatgctatctcatgggtcacatatgtaaattcagggggagttagtacgaaacatgcagtggaaatttgggctgtggcgtcagcaagctcattctgtgtagactctagtttgctgtattggttccaactgatttcagccagttttgttatcttaaaagcagagagaatttcagtgtttcagaaagttgtttttgttttttatttttatgaaccaatcctataaattcaagaatttctctttgccactggttaactctttggggcacagtttcattagtagaccttggcctccatactccaaagaactacttatctactgggtgcagctgaaccatttccataactgagatcatgtaagtcaggaatgtatacacattacacatgtgtgcagacaaaagttcatgacttcacctaccaggtccaagacgagtctccttaggaatgcctgcatacaagcctggcccttggctggtgtctgggaacttggctggtaaaatcattgcctacactaatataaattttttctaaatgagaaaagtagctcacttctcctaaaacatctgttttccttctaggtatctggaatttcagtgactgctatcagtcacactgacagtctgtgctcatgactaacccctgataaaaaccctaaactcttaagctcagacgagcttccctgatagacaacacttcacacaagtttccataccttgttattcagaaaattaagtgcatcctatgtgactccacaaggagaatattctggggagtttgtatctgatatcccttgttgattttgctttctaccttttcagtctaccatatcttagccatgaatgtgactacctgctgaaccccatgaatccttctatccaatcgttgaacctgggagagctctgacaaaggctagcatgggaaaatacgttgtcttcctcattaacagacccttcttagttatatctcactttctaagttcctgccttccacttcctaggagagaaaaaactacacagcattacctgaacatcatcccagggtaatcacagagcagccatctccgcaaaagaaggaaaaatgaactgtgtaatgttgcaatatttttaactgcaaataattttgcatacaaggcttacctacaattgaccatttttgcactaaatgcttttttaaagtaacaagctaatatcttcttaatataaaaatatacatgtccaacaaaatttaacttgttctgctatcatgaaaagaggaattccagacaaatgtctcataatgtgcagtcagtgggcttatataaataaggactaaaattacaagctcaataaaagatcatcaaaccagggaaaactccaagtaaaattataatacacagttgtccctcccacctgagactcacctgagactcatactttccttccaacatgcctgttctgcctattccctcaagactcagacttcaaatgagttccctttaagtagataagaacagtttcgcaacggattccagaaaaaccaatatgccacctaaaggacaaggaaggcatctacactaagaaaatgaaaagaagtcagagagagaacttcctgacttactcagattatatacccatgggtccacatatgcctaaaggccaaccttgtccttaatctttagtcactcaatctataaaataaaagatttagaaaagggctatgggcaatatggatcttttgcaggtacaaaattttttaagtccataaactttctctttaaaacactgaagaccattagtgatggttataatattcttgtctgaactgagagctatagtcaggctccttttagaagccctgccatgaacagagaaaaaagaaaaggcatgttcctactcctctatcctctgtagacatcttctccgtgataagttaataatgagaagagaaaaccaaccttctagctttctcatcatttaatggtttgaaccctgagtttctgcagcctggaaaaaaaaaaaaaaaagaggaagcagcagcagcagcagcagcaagttctcctcatctgaaattcttccctctcctagctcaccttccccaccttctcactcctttgtggtcctcacagtcagatatgaggtaataggtggaaaatacttccctgtgataaggcagtgatgcctgagccacccacttctggtaagaaagctgttcctaaagaatagcaaatggtactcatgttttgggggactctatgctacttagaagcgagtggctaaagttgcacggtgactaattcaagaacaaacagaagaaaaggacaaacagaaaaataaacagaaagaggcatgcccttagcctcaatcaggtagttctaagaaagtgattaggatggttcggagaccaccagccccataccttatccagtcaccaaacaacccaggctggggtgtggttgcctggcaaccacaccttccatgtaccgagtatgtcacaaatatgtctttccggtgtgtgatctcttgactgtgaaaagtaaaacgctaaatcaattcagcaggctttgagtgtctacaatgtgctagtcactgtatcagagatgtggatccagggatgatgcaataacttctgcctccaaggagctcatagtttagtggacatctggcaaagtactcactgattcttgacaattcatataatcatatcaatagatgcaaaaaagcatttgacaaaatccaaattccatccttgatttaaaaaaaaaaaattcttagaaaactaggactagaggcaaactttctcaacttgataaaaaatatctacaaaaaaaatctacagggagaatctagaggctttcccctaagataggtaacaaggcaaggatgttctcttttaccactcctattcaacatcttatacaacttctgactaattcagtaagaaaaggcatacagttgaaaaggaaaaaataaaactgccttgcttctcagatgacataaatgtctatataaaatatctcaaagaataaacaaaaacaattagccacttaatctataaaataaaagatttagaaaagggctatgggcaatatggatcttttgcaggtacaaaattttttaagtccataaactttctccttcaaacaccgaagacctggaacttagctgggcgtggtggctcacacctgtaatcccagcaccttgggaggctgaggcatgcggatcacttgaggtcaggagtttgagaccagcctgaccaagatggtgaagtgccatctctactaaaaatacaaaaaattagccaggcatggtgccgtgcacctgtaatctcagctactcgagaggctgaggcaggagattctcttgaacccgggaggcagtggttgcagtgacctgagatcgcgccactgcactccagcctgggcaacagagcgagactccatctcgaaataaatcaataaataaaaactcctggaacttaataagcaattacagcaaggttgcagaatacaaagttaatatgcaaaagtcaattccttttctataaaccagcaattaacaattggaattggaaatataaaacacagtatcatttacattagctgctccccaaaactgaaatatacaggtataaatataacaaaatatatacaggatctatatgagaaactctaccaaactttgacaaaggaaagcaaatatctaaacaaatggagagatatttcatgttcatgtatagaaacactcaatatttttaagacctcaattcttcccaatatggtttataaagccaatgtaattccaacaaaaataccagcaaattgtttcatgggtatcaacaaattcattctgaagtctatatgaaaacgcagaaaacccaaaataatcaacaaaatactaaagaagaacaaagttggaagacagataatacaagatttcaagacaagaccacaaggtactgttgaaagaatagacaaatagatcaatggaacagaatacagtatccatataaatatatccacacaaatgtagtcaactgatctttagtaaagaagcaaagaaaattcagtgaagaaagaatattctttttcaaaaaatgataatggaacagaccttacacctttcacaaaaaaataactcaaaatgaatcacagacctaaatgtaaaacacaaaaactctcaaacttctagaagataactgtattggtgcccaagagctgctataacatggtaccacaaactaggtggcttaaaagaagggaaaacaaatctggaaattagaagccttaaatcaaggtgtcagcagggctgcactctatctgaaggctctaggggagtatacttccttgtctcttcctgtcttttggtggttgccagaaatccctggacagcacgattcaactgtctcacacaatttaaaccacaacagtcttctctccaatcccccaaaagtcatatccttactgtatgcaaaacacattcaccccatttcaacatctccaggacccttgacccattccagcatcaactctaagtcaaaattgcctctaaatatcaactgtaatgtcccaaatctcatctcctaaatcatctaaatcaagtatgtgtgagatcctgggtatggtccagcctggggcaaagtttctctcctatggacactgaaatccacaaaacaagttatctgcttccaaaatacaacaggcataggacagacagtcaccttccaaaagggagaaactggaaggaaaaagtgggtcacaggtctcaaacaagtccaaaacatggcagggaaattttcattaggtttccagggcctgagagggctgtctggatccatgagtcacacaggtaatcttttcagtgaatggttgttcagccacacccttggtcctgtttcgggagtatgtttcctggattggctgagaactttcaaacccatcaagtgctggttcctttgcttaacaattccttcctcaagttatctctttccttttgcatttcactataagcagcaaggaaaaaccatggccccatctttcacgctttacttagaaatctcctcagctcactgcctacaagttctgctttccacccacaggtaaaacacagttcacccaaatttctgccactctgtaataaggatcacttttcctccagtgtctgataatatattcaccacttcctttctaaggcctcacaagaagcacctttaaagttcacatttctagtaacattctgttcatgacaacatatgtattctctaagatgcaaagaatctatgatagatgctttttctaaaattcccctctctactgagccttcaccagaatcacctttaatatctgtatttctacaaatagtcttttcaaagcagtctaggctttttatgttatgcacctaaaaattattccagtctatacacaattccaaagccacttacatgttttttaggtagttattccaacagaaaaagatttccgggtatcaaaatatgtattcatttcctatggctgccataacaaagtgccacaaattggatggcttaaaaatgcagaaatgtattctctcacagttctgggggcagaagtctgagggtggcagcaaggccatgccctctgttaggccccagggaaggatgtttaattgtctcttcctaacttttggtggtttcagtaatccttgatgttccctggttatagacatcccactccaatttcagcctctgctgttacatgaatttctccctctgtgtccaaatttcccttgttttacagggacaccagtcattgcattaggacctcagcttaacttgtttaacatttgcaaagatcctatttctaagtaaggttggactcacaggtatctggggttaggacttcaaaatattctcttggggtataaaattcaaccacacaacaataataaaagagaaaatctatgtgaccttggttttggcaatgagattttaaatacaacaccaaaaggataatccaggaaacaaagttgataagctggactttattaaaattaaaaacttcttttctgcaaaatacactgttaagagactacaaagacaagctacagaccaggagaaaatgtttgagaaagcacatatctgacagaaaatttctaataaaaaataaacaaagaactcttaaagctcaacaatgagaaaacaaacaacctcatttaaaaattggcaaaataggcatgccactgcaaattccgtgaaacaggagaaaaactgtgagttcccaaagtgtaagagggagaaaaccgacctccaaacacacatccctgctgggaatctgaaaatccagatcacaggagaagaatttaaccttacctagagatggaagggatttagagagtcacacaaaatatgaaagtagaagtagcagcaggaagtgccttgtatgcactcccagtctccagctcgagcatagggacgccatccctgactatatctcactggggcccttgtggaagacaaccagcagaactgcggaagtgttgtggggtgaagaaagctcccagatgaaattggtagtggtttcgactgggcacacattttctggagtggagtccgaggaaggagcaggagctgctgcagatacaagcaagtacaggagtacaagaactgccaccaacagagcaggggcaaggtctgggcggggcattgcaggatatgcgggcttgccaactgcatgggagttgagtcaggcctcttgctactggctatccctgacttccctggcaaactatataatacagtagaggcggccaagatcccctatggaacataaccccattggccggagaaccaacccccagcccccacagtggcctcagcaagccccgcccaaggagcttgcctaaccctgctgcctaaccagacctgcctaaccctgctgccacctgacggcatttccctacctgccctggtagcctaacacaaaacatagaaactctggggagcttcatcccctgaaccctgcccccagcaccctctgctctggagggttgtctttaattgtctatggagcatatatatatatactctttccctatggtatataagccctgagtctggggagtaatggtgtgaacatctacctgtcttacacgaacacatttctgcccaagaacacatttctgtccataagtttcccctaaaaatcaccctctgccaataaactagatatgcctgcctcattctttgatttcttggctccttctgtatttggaggttattttgcatatatggccctttcaaggaatatctatctatataaagataaaacaataagctatcaagctataataagatatggagaaagcttaaatcaatgtttctaaagaaaagaagccaatttgaaaggctgcatactatataattccaactatatgacactaggaaaagcaaaacttttgagacagcaaaaagatcagtggtaagcaggggttcaggggttgagctagaataatgaacagaagaagcacagaagacttttagggcaatgaaactattttatatgatactataattgtggatacatgacattatacatttgtcaaaacccatagaaatgtacaatataactagtgaaccttaatgtaaactacagacttcagttaatactaatctatagatattggcttattaactatagcaaatgtaccaaacaaacacaacatattaataacagggaaaaccatggggctgagggggtatagggtaactttctgtactatctactcaattttttaataaatctaaaactgttctaaaagtagtctgtaaaataagatttttaagagcaaacagaacaagaattttaaaagataattgtctgaagcacaaataatgacaattatatggtgcactttataagatatgtagatgtaaaatgtatggcaatcataacacaaagtatgggtgggaaataatggaagcacactgttgtaaggtatatatattatactatatgtgaaatgatatattatttgaaggtagactgtgacaaacttatacagcctagagtaaccactaagaaaagaataaaaagaaggagaagaagcatggaggagaaaaagcagaagcaacataagggcagagtggagataaaatggagtaaaaaattgagtcattaaagaaagcctcatttaagccaaaagggtatgggaaaagaagggactagattaaagaacaggtaaggcaagtgcaaacctggcaagatgatagattaagatctaatcatatcaataattatattaaatgtaaatggtctggccatccaaattaaaagtcagggattgtctgactggattaaaaaagtgagatccaattatatactgtctacaaggaacccaccgtacatataaagacattgataaactaaaaaaatggaaaaaagataacccatgtaaacactaatcaaaagaaggtagaatggccatattaacatcgacaacatagactttaaaaaatgataaacatttccagaaatgaaaaggggcattacataatacataggaattctaaatgtgtgtgtatccaacaacatagcttccaaagtgataaaatgaaaactgaaatgaaaaaaacagaaaaatctacaacaatgttggagacaagtaggcagataataaggacacagaaaacctgaataacattatgaagcaatttggcctaacttttatagggcatcccagccaacaacaaaataagtattaaagtggacacggaacattcacaaggatagtccatattctgggcctaaaaacaaaccataaaacattaaactgaaatacaaaatatgtttttaaaaatggaattaaaatagaaatcaacagaaataaatctttaaaattctcaaatatttggaaattaaacaatatatttctaaataactcccaattcaaagaagtgacaaaggaaattatacaatattctgaattgaatgaaggtaaaaatacaacatcaaaattagtggatgcagctaaaacagtgctgatagagaaatttatagcattaaatatttatattgggaaataatagaggccttaaatgagtaatctaagttcttaccttaagaaattaaaaaagaaattaaatccaaggcaagcaaaaagagggaaataataaagaggaaaaaaaatcaatgaaatggaaaataaaaaaataacagagaaaaatcaatgaaacccaaaacaggtccatgaaaagattttaaaaaaaattgctaacctctagaccctcaatgtccagtagaactttgtataatgatgaaaacattctatatagcagcaccctccaatgtggaagccacttgggactactgatcacttaaaatgtggccagtgtgactgaggaactcaatttttaatgtaattttattgaaattaatttacatttaaatagacacatgtgactagggataactattgaacagtgcagctctagaattgactactgaaagaaaggaaggggtgggaaggaaagaggaagaggaagagataaaggagggagagaaagagggaggcagagaagatgagatacacaaataaccaaaatcggaaatgaaatgaaaaagaggacttcactacagatcctaatgttagtgccattaaaaggataataagaaagtattacaaacaactgtatgccaaagttgataacatagatgaaaaaaactaattccttgaaagacacaaagtactaaagttcactcaaaaagaactgagtagcatatacaatctgaatagccatatatagttttaaaaacttgagtccatggtataaaactaacacaaggaaactctaggcccagatacctccctgttgacctctaccaaacctttaaggacgaataacaatcctatacaaaatgttccagaaaatagaaaagagaacactccaaactaatttatgagaccaccattaaccttgataccaaaatcaagaatattacagaccaatatctttatacaccaatatccctcatgaatgtatatgcaaaaaaaaccttaacaaaatattatcaagtagaatagatttatttctccatttatttggttttctctcttcaatgttttagagtttttagtattcaaatattacagaacatcattagatttatccctcagtttttcatgtttttgataccattgtaaactgtatttctaagttttaatttccaattgttcattgccagtgctaaatacaattgatttttgtatattggcctcacatcctgtgtctttgccaaagtcatgttatttctagttgcttttttgtagattcctcgggctcctacataaacaatcatgttgtctgcaaataaagacaattttatttcttccttttttatctgtgtacatttatatcttttccttcctttatttcactgactaggacctccctataacgaacagaaattgtgaatggaacatccaatgtgatgctggtataagaatagacatatacctcagcaggaaagaacagagagattagaaataattcacacatagcaacaattgatttaggaggggaaaggtgccaagataatataatggggataggatagtgctttcaacaagtgtgtgggaaaatgagacatccacatacagaattatgaacttcaccccatactcatattatgtacaaaaatccactcaaaatagatgacagacctaaatgcaaactctaaacctataaaacttctagcttaaagcttaggggaaagcttttgtgacactggattacacaaagatttcttaagacactaagcacaaaccacaaaagaaataattgataacttgactttgaaaaaatcaaaagcttctgctcttcagaagacagcattaagaaaatgcaaagtcaagtcccagtctgggagaagatatttgcaaaacacacatctgaggaaggacctatatcctaaatatatagacccttataactcaaaaagaggacgacccaattttaaatagtcaaaagatgtgaacagatacttcaccaaagaagaaacatagatggcaaataaatatatgaaaacatgattaagacaactggtcaacataaaaatgcaaaggaaaaccatacgaaatactgctacatacctactagaaatgctaaaatcaagcacacacacacagtccaatacaaagtgattctggtgaggatgtggagcaaatggaatctcatgcattgctgctgggatctctactcatcatcttgctttatttttcccaaaaccactttttattaccttaaagtttgcttacccatgtaagtccatatatatcttctcacatgtttattgtctatcttccccaatataagtactatgaggctggcaacttggtctgtcctgtcatcactgtgtcattctggcaccaagaacagtgtctggcaatctttacatatttattaaaagtgaggaaggggtggaaagaaaagacactaagacatctataagtgaatatatgaaggcaaggaacccagtcacagccatctacagaggagcgttaagagaaaattaatttagaccaccaggaagctgcatgttgtaatgcatgattcccaatttcagctgcacattagaattagctggagagctttgcaaaatcccaattccaggccacaccagaccaacaaaatctgaatctctgagaatggaacaccagcactggtcatttttttttttttttttttttttttagacggagtcttgctctgttgccacgctggagtgcagtggtgccatcttggctcactacaacccccacctcccagattccagtgattctcctgcctcagcctcccaagtaactggaactacaggtgcatgccaccacgcccagctaatttttgtatttttagtagaaatggggcttcaccatgctggccaggatggtcttgatctcttgacttcgtgatccgcccgcctcagcctcccaaagtgctgggattacaggcgtaagccaccacacccagccaagcactggtaattttaaagttcccaggtgatcccagtgtgcactcaaagttgagaatcactgaaaaaatggaacctagaccttggaaatgtacacaactgagtgtgcaagctacttaacctcccttagcctcaaaattctcatctacaacatgggaaatatatgtacctcccagagttgctgaaatattgagattctatataaggctctcaggaaatgtaaattctcatccccaagggaaacttgatcaaatcttcatagcttagggtaagaaatgctaattctaccagcaattcacatttttcattgttagctgattattttattgaacatttacattgaggaaattcagaaatgctcatttttccactttcctggtggtaagatgctgcctgaagctatgtttaaattttcaagagtaaataaactatggcgggaaatctagctgactatgccagtgaatctcaaacctagctgtacattagaatcatctcagaaatttttttaaagaaacacacgtacgtccagaactcaccaggccaaattaaatcagaatccctggggtggctccagaatatcagtatttttttaaaaagctgatagaaaggtaattgtaaaacacagtcagggcttaaaagcactgatttgtactaacgatatgccatgctaactgcacatcacagtcacttggggagctcttaaaaaagttgattgattccagaaccctaccgagacttactgattcagaatctgtggaagtggagcctgtcattgtgcaaatcttcataaaactccccactggtgattctgatgcaaactcactgagaaccactactttgtatcatacatttactctacgtgttgtatatcagaaagatcatttaaaactttcagtggtctcaaatgccaagcctgccagttacttttaatcagtaactgacacaacacatcacagtaactccaatgactttacagatcttttcagaacacttttatgtccagcccactgacccacatcacctaccctatgctgtgccaaatactggctatgtagtccgttggtatttctaaccaaattcctctaaatgggctgctgatctgggaaaagcaacatggaatcacattactccccaagccttattcccctttgctaagtggtatgtaatgccaggattaatgaaatgaactctattggtcaaatgagtctgaatgaaatctgagttgttgtctgctcctggaagcaaactgttatctatttgtttccctcagagagataaactcagaggaaacaggagtgatccctgaggtgggaataatatagtgggctgcaattttaaaactctgcttagacaataacaggacacttggaatcttattttgatagatcaaaccaatcagtatatacagcaccatggtggtactaccaggcaggtgataatagtagcatttaaacaaccaggcactatattaggcatattaaatatattaactcatgtgattctcaactgcgatgataatagccctatcaggcaggtactattattatttccattttgtcaaaaaagaaacaaaggcacacagaagttagatgatttacccaaagtcccatagctactaagtggcagttttctgaaaccaggcaatctggctttggagtccaacatcttaagtactccactgcaatgcagatgagtgatggccaagcagtttaaaaaaaaagaaaaagttattgtctgcagtagaaactggaggtcagggtatgggtaccttgggcaaattacttaacctcttggagcctatttttgcatctgaaaaatcaggataataattgtacctgccttgtagagctgaggtgatgattaaacaagattaggcatgtgatgtgcttagaaaagtacttggcacttttaagagctttctgtcagccattattattatttgtattttaaaacagctcaagtggtcagggagaaatgaaaatctattaaactgaaaattttcctgccaatcttagatttgtagattctgtagattaccagtacatcagatccaatatgaaatgcagtcataaaagattttcacaaaaacttaaggactgtcactgtgacaaaccccagcccaaacagtccaggacaatggctctaaaaagcaaacatcttcaattatcaagctgtgtacatgtaaacacaacaggaaccagacttctgagtagctgcaaactgcagttctctgtgatgggagaacatgccccagaacagcctgtcaagtggtaattgccagccatcctcagtcacatatgtataaacagaaaagaaaaacaaaacgagggctcaaataaaaagcgttaacattcattaaacgcctgacactctattaaatgtttttcatgcattaccttctttaatcctcacaacacccttccaaagttgaacatgaaacaaccacactggtttatatcactttaaatgtaagactacacgtctcaaatgggccctgagcactgcctgggaatccaactctatttctctagtacgctcactttcaccctctctaggactctgtcacatatctctcctccaagttcccacacctttcctctcccccgctgccctccctctaagctgatggatgcctataccaatagactcttttcccaccacccactgtatctgcacctgttatctcagcttcccctctagttacaacagagtaagtgtccctgctcatttcaaaaccaactactcacctgcttagggtcttctcctttctcaggtattcaacaactaccctttacaatgttcccctctttcatctgcagcagtttttcctttctacgagtttaatcacattgccatataaacattctgctttcttctatcttgaaaaaaactctacccaaccttaaggcccctcttccccattaaagttgttcttgtcaaaatgattaaaatcctcctaattaccaaaggcatcttatacggtaacattcaacatggttgaccactacctccctcccttttttggcttcgcctcctcttctttgtgtacactattaaactagatgtcttcaccagtcccatatattttaaatactatgtacagtatatgatgccgattccaaaggttaactctagcccgacatcctccagaacttcagatttaaatttctaaaaagcacatttgatatctcaacccaaatatctactagataatttatgtgtgtatatttcaccatactaaaaaaaactaccaggtgactgataaatggagagaaggtgaataggtaatgtgaaaaatcaaatgtgctaaatattcatggcacctgtaggtggtaggtggtcagagtcctctgcaaaattcttcccagctatgcttatgtcttctattgggaaaaacctactgggcatctcaaacctaacacattcaaaacataagtactgattccacaacttccaaaaatgaaacctaccccatcctacagttttccttgagtcaaggctagcatatgagggccttggcatatgggggcattgcctatcgcgttcatagatattctgagcttctagaacagcatctggcacacaggaggcgttcaaaatagctgctgaatggattgatgaattcatgttctttctttctaggtccctcgacctccacccgcccttgagtcattgggaagttctgggctgtctcagcgcctgatgatggcttcttaccaatcataccacacggctgctcctcagggagttggtggcattcccctaccacagagccacagggttcctgtcccggtcccgtctcgcataggcgccccaacacgcgtcacagtgcagctggcatcacacggccagaatcacgtcctgccctctggctgcagcgacactacttcacagctcaggcccacccgggcagtctcccgggccagggccacaacccacgccttgtgacccctgcacgtcaacggcatcttccttcttcacgcccgccctcccacagcccggcgcagcggcctcccgcacgccccctgcccacctggcccccagccacctttcctcacctgggcctgcggggccgccccaactgtcccgctgcaaccccagcagcctcgccagttgggtccacgcctagcctgccggccttcgtcgctatccaatcccacctgcgcccgcgagcctgcgcactggagctttgccctgcgccgcggcactctgccctgcgccgcggccctctgcttgccaggccgggagagacagaacctgcctctaccggtcttccaaggcactgagagcccatcgccgcggacgccgctgtaaattccctgcgggccctgtgcaccaccctgtgcgcgtccccctctcccaggccaggctgataatgttaacagctctctgagctatgctcatatcctgaaccactgaggactgtgttctccaggaatgctcgcctgacccacgcctgccctctaagcccctaatgaggccccagagggctggggtgggggggtctctttgtagtatcagagcagggcagataggcaaaaggagtcagagcctgtgccagaatatgaggtcagttggctgctaggtcaattaagacaacttcagcaagggtggtcaatgtagagggaattcaatcgttggcattgcctgaaaacaggaagccagaatctttttatcttgacgaacaaacctctattcattggtcctgacctgagccactttggtgaatccagataccctgaaggtgtgacaagacctgcctcacttatcccccagccttcagtgctggtcccacagagagccatatgcttgagctgaactgcagttaagcagtgacagctaccctctgtccaggctctgaggccagctttctgctccgtgagtcactgacagtgagtctctacagagactttttctttctgtagcagccaaggtaccctgcaagcaacccacgccattgccatatgtcttagtttgtttgtgttgctataaagcaatacctgaggctgggtaatttataaagaaaagaggtttgttagtttcacagtttcacaggctgtaaaagaaacatggcaccaccacccgcttttgatgagggcctcaggaagcttccactcatggcagaagacaaaggagagccaatgtgtgcaagacagaggaagagagagaggtgggaggtgccaggctcttttccatgaccagttctcatgaaaacaaagactaagaactcactcagttccatgagactagcaccaagtcattcataaaggatctacccacatgacccagacacttcccaccaggccccacctccaacattggggatcaaatttcaacactagattttatttatttatttatttattttgagatggagtctcgctctgtcgcccaggctggagtgcagtggcgtgatctcagctcactgtaatctccacctccccagttcaagtgattctcctgcctcagcctccccagtagctgggactacaggagcatgccaccatgcctggctaatttttgtatttttagtagagacgaggtttcactgtgttggccaggctggtcttgaacacctgacctcaggtgatccgcccgcctcagcctcccaaagtgctgggattacaggcatgagccaacgcacccagcccaacattagatttagatgggacaaatatccaaactatatcaccagggtaagattcccctttaaagatggaccccatgtctaatgtttcttcatagtgcctaacatcaagattctgcactggtcatcatttcacaaacatgagcagcatggctgctccaagacacacagagggaataacccccattcacatcaccaggaaatccttgcatggaggctaaatgaacagttggtaagagtggaccctgaggtgtcattccatctcccccagacttcctgcttgaccacacaatattcccagaagccagtgacccagaaggctcttcttggctttctgtccttttacctgtgaaaaattcgaagaactataaagtttagggcccatcacagtttactacccttctttggaggcctctttaaacccttgagtcttaccaattaccagtagcactaggagctttgcaagcctggccttaagtccctgctttgctactgaatagttggtgacctttggcaggttacttcccaacttgtgtctcagttttcctttttttaaaaaaggagacacagttgcaagtgtttaatgacacaaaaaacagaagcattcatcaccacgcctggcagtgaacactgcttttcttgctcaagaggtttgagccatacgcttctctaggtctgtgactctcccagagtttctgggagttcctctgtgagcaacagacccactgcagtctccatactttaggggtaagcctggatgcccttcacacatcagtctggatgagttcatgcaccactcatccaaaagtgaatccaaaagtgattccaaaagcagaggccagagatctagttgctaatgttgcctctcctcatggttctaggattcagccacacagggcttcccattgcagcttcaggtcctcctcactccccagtgcaggcccagtttcactctcaggtcctccagcccaggcctcagttctgcctcttttagtccatccctccagatccactttccaacagggctgggaagtcgcttggttgtcccctgcctgctgcaccacagcccccagacaccgcctccttatttcctgcatggtccgaggctcaatgctaatccctgggtgtcttagtctgttttgtgctgctataacagaattcctgagcctggataatttgtaaagaacaaaacatttttttctcacagttctggagaatgggaagtccaagatcaggtgccagcatctggtgtgagtcttcttgctgcatcctccagaggagaggaacattgtgtcctcatgtggcagaaggcagagagcaaataggaaaaaggaaggcaaactcaccctcttctaatagcattaatctcacccagaaggacagagtcctcatggtcctttcacctcccgaaggtcccacctcctaacactgccacagcagcaaccaaatttctttgaatattaatacatgagtgtgggaggggacaaacattcaaatcatcacactgggaaggctcagctggaggagcagaattggccagcacagggaggtaatgctgggtttggaatttttgtctttgcagtccttggccttgatccggatacccagacgccctctgagatggaccttgagggccgtgccaatgtctgctctctgctgaggtagggctcatctactccttacaagtataagaacttactgccaaacataccctcctccaagccatgggtccccagatacagtcaggaggaccccagtggatagctggaactcaggacctcaggagagatcccaaggcctatgctcgagttcagagttttctaattcaggcttggagcccaggaacagaagataattaagaacaatactgacagaaaaaaataatcacttcattgacattacccttcacaggaccgcctgcttcaggcctgtgctttgcagcctggttcatttgggaatggtatgcttcacacccagccctgttaagtgtgagttgatgaggaccatgagcttggaagaagccgtgggggcctctctgtgtgtttctctctgccctgctttgagacacttcacataaaagactctataaaaataaactgtggagatttcaatgccagtaaaaatcccagtggaggtagaaaactatttaaagagcacaaggacatacatttatcttgttgtgaatccccggctgcctggtccctgagcctgacacacggcagatgcccaataaatattaatagattgatcaatttgttggctgctcatccatttgcagcttcagccagcccatggctctgcgtgcacacaccacaaggagagagaatccatagacttcgacaggagagagctgctcagctggcaggagagcctgccacaaacccttgaacataaatgtcctgccctccacttccagctctacgtactaactgtaaaataatgatgtggcagaaagtgaagtgcaaagactgccaaattctaagaaagaacctggtttcatgccttttaatccttatgagtcattccttggtctgcgccaagccctgtgctttacagcaagaatacagatgtcttcattgaactgcatctcattagctggacctaacagagtgcaaatttctttccaatgccatttgaactcaatgcccagatgcttttttcccctgggcccgtgcagatgaaatcttgggctggtttataactttgaacacccagaatattcccatttcagtttaagattccctctgacttatctaattgttaggctctcttcaccttcagcctgagaaatgggtaccatcaatttctcctttctcacccagcttcacacccaggccctccagactcagtgggtgtctgacacctctacagctggagtccttcagcaatgggccccctgggctcagcagatattttgagctggccatttcttctgtgagacaatcttgtgttttctcaggaattcccctgcagaagatctctgagtacaaacccatgcccagtgatgttgcctctgcccagctacttacaagaccattcctcggcccatccagggctaccaatctgtttatgtaatttgtgccatgaataaaggtaccagacaaatgagtaagtggaggctgagttgtaggcatggttttgtgccccaataatgggctgcacaggaaaggaagggccacctttgtgtaattcataagctacaggtggatgcctttttgtgattccccctaatgcatgctctgtgtgagctgaggctctggctctctctctgctggggtcaacatcacccctgcttgttttacaggctatgacctgcctgcagcttacttgcctacataaaaagggcatccgcgcccttgccctgacacagggattggcggttcactcctagcgccatcctctttctctttgctctcccgccagacatgttgttgccgtcatcacctctcaccatgagattgctcagggatgttccagacaccaagccctttcagaagacacatgtcaaaccctgtatatgatttgagcagtctttctcatgtggctggagggaaaggagaggtacctcattcctctcccctccacaaggaggggaaagaggtatggaaggggaaatgtcatagcattccaacaactcttttcagaggaattttctactcctggcctcaattttttataaaccctcatgggtgtgttagtggtggaagttatctaggttatcggtggcaaacctgtatgggtctgcagcaatctcaactcttgcctcctcagaagaaagaatctgaggtgcataaggcagaaggagaggccaagacaagtgttagagcaggagtgaaagttcattaaaaggctttagagcaggaacaaaaggaaagaaagtacacttggaagaggcccaggtgggcaacttgaaggacaagtgccccatttgaccttgaacctaggatttcatatgctgaccgacttccagcattttgcaccccatttcccttgatttttctctcagggtgagctacccacatgcacagtggcctactagcacctgggaggtgagcatgggcagtgtgtttagtggagctgtacgcatgttcacctgaggctttcttccctttcctggtggaatgcctctggaaggtcatactctgccattttgcccgttaatgtgcatgcttgagcccacttgcccaattcctgaaagctgccagttacagatgtttttatctattgggaagctgcctctctctggtgctggctgtgaccaattattctttcagagaggcaatgtgacaattgcctgaccatcacctgttggttgcctgacatttcttgttggtgggggtagccctctcctgctctgctcctgcctgactagctacctaccaggaactccaaatgactgcaagagagagtttggagatggtccaagagctgggattggaattggagaactaggttatagccagatactggagagtttcacatgccatgctaagaaatttgaactttatcccataggattgcaggtgaacgatattcagcaggagagtacctggtcttatttgcctctgagcatgctgggtggagaggcatgatgaaagtggagacctctttggtgtgcactaagtaggttaataagcaatgttcagagaatcttccattcaaagtaaaaaaatttctcacctttttttctcatttctcaaggtggtttctaattcggtcttgagagccagacattcttcctggtttgggttttgtattcttttatgagttcatcaatcaggtgaggccacaaggggagacttagtgctcaggaacacaaaatctattatactcttgggtcctagagacagcaggcacagcaggccacacaggaccacatggggaagacaccagggtggccaggagactgaggacaggagcatgcatttgatatacaaactaaccagcacagagctacatctctatctggccctacgctccagagaccatattcctctccttaatcatcccagggccaggtacaagacaactagaaaccgtgcctagagccaaagcccgctggaatgattcaaactagctagtcctaagctgttcaccctgccttgccttgcctttcccatggaaacccggtaaaagctatggcctaggtggccccctcacctgtcttctgcctcctgaccaccctgatgtctttcccatgtggagtggcatggaatgcctcctgtttctaggacctgtgtgtatcataaactttattttcctgagcctgtcctgggtctcttcttgtggccacacctgactgaccacatcataaaagaatacaaaacagcttgccaggtccttaggtgggcagcatgattgagtgagaagggcataggcctgggttttatttcagtgcctttatctacttgtggcctcagacaaattattgaacttctctgggtctcaatttcctcatctataaaaatgacccttgcagtgtacgagtcagaataaactagattatgctgctgtaatagataaaccctgaatcttagccacctgtatcagtaaaggtttccttcttgctctcagtgcatatgcagtgagggtcagctggccactctgctccctgctccctgacttagcacacaggctgatggcacgcccactgtctgtgatcacattaggatcttggtgacagatggaaggagcactctggtgggtcgtccacctgcaattaaatacaccggcatggaattggcaatccatgcctctcctcacagctccgtggttggaaatcacatggccctgctccaccacaaaggggccctgtgtgactaccacagatgcctactccacaggtgtagggtgagggttacatgggctacaacacaaagagcctggtgcagggcttgaaggctggcaggttctgacaaaactcttctaggaagagcagcctccacccacagctgtggtcaagactaccagattcgcactggcaagtactttagaaaaagcatactgtctacagtaacactgctaagcatggagacttatttatttatttttgagacagagttttgctcttgttgctcaggctggagtgcaatggtgtgatctcagctcactgcaacctctgcctcccgggttcaagcgattctcccgcctcagcctcccgagtagctggaattacaggtgcccaccatcatgtctggcttaatttttgtatttttagtagagatggggtttcaccatgttggccaggctgctctcgaactcctgacctcaggtgatccacccaccttggcctcccaaagtgctgggattgcaggcatgagccaccatgcctggccagagcttttcactttaaaattatttcaaaatggtaaaaggaaatctgaaaagtccagtgaaggaaaaccacttgggaaacagaaatcccaaagatcaggattgataaatgtctctatcttcgagttatagacagagagggctccaaggacaaaatttgaggaaagatggttgataatctcttgtgtaagaaagttttcatttgcaagaaacaggcagagcaacttaagctggcttaagcatgcatagactgattgccacaggagctccaagtcccgctgcatgacagggttcagttggttgattcagttataacaactgggaccccagctctcaccattcttcctgctctggcatccagagtgttgatttcgcttggcttcctttgaagacagatcccttttaaggtcatggaaaggctgtcagaagctatacagtggggtagataaataattgcttctggaaattttccctaaagatgtgtgggcacttttctaaaagtccctatgaaatatttgtgtgtttcactggcttaaatttaactatgacttctgtccctagcaagaagggttgccttaaagccaattgggccttcccttctcccccacctctccttaacttcttgtaaccactaatccattctccatttccataattttgtcattttaagaatgttctataaattgaatcatacttgtactacctttggggattggcattttctcattccacataactctctggagtttcatagaagttgttgtgagtatcaatagttatttcttttgatatggattaccacatgttacttagccattcacttatttgaaggatatctgggttctttctcatttggggtcattacaagttaagttgctatgaatattttcgtaaaggtttttgtataaacacaaatcttaatttctctaggataaatacccaaggtgcaattgctgggtcttatggtgatcgtgtgtttagtttcgtaagacccaatcaaaccattttccacaatgtatacactattttacattcccatgagcaatgtatgagcaatcccctttctccatgtcctcagcagcattaggtgttgtccttattttttatttgaccatcctgatacatatgtggagatatcttattgtagtttagtttgcatttccccagtggctaattgaagttgagcatcttttcatgtgcttatttgccatctgtatattatcttcagtgaaatatccattcatgtatttttcttattttctaatgggatttttttcttttgtcaaggttgagttttgtgagttctttatgtattctaaatactagtcctttgttccggatacttcctcctcatttgttgcttggatcttttatcctcttaacagagactttttacagagaaaaagaataaacaaaaaacaatttgtcaagttttccttttctttttacagatcatgcttttggtgtcaagtctgagaactctttgcctagccttagatcccaatgattttcttcccctttttttccctaaaaatcatatagttttgcattgacatgtaagtccaggatccatatggagttcatttttgtacaaggtgtgaggtttaatgtcaatgatctttttttttttttttcatctacggatgtcctattgttccagcaccatttattgaaaaagcaattctttcctcattgaatttctcctgcattttgtcaaatatcagttgggaatatttgtgtgggtctatttctggattatctattctgttccattgatctatgtgtccatctttctgtctcactattactgtagctatatagtaagccttaatattaattacagtgattcctcccactccactctactttttgaagattatagctattctagtgcttgtgcattttcaaataagtttcagaagatatttttatttgtataatgtaaattacattatgaatatacaataaaatttataaaattaatttcagaacaaactcatctatgattacaaaataccttgctaggattttggtaagaattgcattggacctataaaattaatttggggagaattgatgcttttactatgttgagtttggaagcccacttttgcactacaatttagtgctgaatatgtatatgctttagcaacctcataacaacggtgtgctggcacataataggagcttcataaatatttatggcagggaggaaggatgggaaggccaagtgaagtcttgaagagtttggatcagttgtccttaaatctggccacagaaacaaccatctgctgagcttggtaaaagtacagatttctgggcttcatctcagccctactgattcagaatctccgggatgaggccagtgaatctgtattttgaacacctgctatagttgatcctcaagcacagccaggtttgtagcatgtagcagccaacaatggaagcagtgtgcaggcgctgagctgagtctcctaggaattagctgttctttctgacatttgccctgaaacaaagcaagtggtagctgcaattgagtccacctaagacaaattaacatgttcttcctgatatatggctcaaaatgagtatagcagcctgggagtcaagggtggtcctttcctacaaggaggaggaccagatgtattttgagcctgtatccaccaatttcttttccaaagaggaaataagcaaccaatgttcagcagaatgtgagcagttcctaaattgtaaatactgttatttaatcacttcattgcatacttgattagttccctaaccttgaggcctgtgaaactgtaatgatgcaccaggggagctggcctcagctctgagagaatttagaacaaggctgttcagatccctggaaacatctttttcattaatagcagaagaagccaaatgacccataagatttttctgtcataaggagaacagaaaaattagaaacaaaagcacatagaggagagttcatgaattagattttagagcacagacttttttaatcttagtctttgtttttgtttggttggttattgttgctttccttctcttattttgcagtttcagtctctttattttcaatgtaaaatttattatataagtaatagatatataaaggtaatttttaacaaaataaagtgtattctcctaatcccatcacccaaactttggtcaatttctgttccattgctgagcctcccctctgttcacggtgcttctccttgtgcctgcgaggcattccatagttgtaaccagcatgtaattctgagttattatatcaaacactttactaagttgcgagttcttcgtagttatattactttcttggcagtgcagtattctattatgctattgtaccatcattttctctaatgttatcattattctaatgcatttcagccaattccaatttgttgtttttatcaagagcactacagtgaacatttttaaataaattgatttttttcttattctggattatttctgtgggataattctcagggatttcattgttgggtcagtgggtatacccatttttatagcttttgatatttctgaatatgccagcttcagcaaaattttgccagcattggacagtttttttaaattttatgaatgtaatgaatgcaaatcagtatattgacattgttttggttagaatattttgtgtgtttgttggccatttgtattttatcgtatattttgtctatggaaatcctgtattgatctattataaattaaaatgggctttctaaatattaaaaatattaatctttgttcacaattatgtaaatgctttcccaacccattgctattctttttacatgagttttgtcattattattgtatggaagtttaaactttttcaatattgtcagctttgtaggttttctgttgttatacttttggtctactgcagtaagctggaagagtgatcattcctctgcagatctgataaaacgagagcctgtttcctaccagtctttctctgatgtgtgtgtgtgtgtgtgtgtgtgtgtgtgtgtgtgttttatgtgattctagtagatgaagtgggctttgaaactgaatcatttttccagctctcccagttgtatcaatgaagttgtctccccttcccctatgctgagaccccaactttgccctgctttctctgttacacagcaccagatatgctcctgggcctgcctgtggtcccccagtgtttcttttgtgcatttgctaatccatgtgtctttagttctttgtcctaatatggggtaatgctggatctaacacatcactctgctttctttactagatatccccatcttatttttccttcatatgctttgtagaatcaggtataaagtccaaaaggaaagtccttttaaaagaatgtatagctatgtggagttgtatagaaaagatacagaaagatatcaaaacatattacacccataaccttggagccaagccccttaacagagtccttccactgtgataaccataaaactcctttgttccaaggtgaactatgaagtgcaccctgcaacactgtatctgtcccggagagtgtgtgccagtgctgcagcaagacttcaccctgcctggggtatcttggaggaagagattggttctcaattcctttcacaaagggaagcccccacccccttctcaccacctccccttcccacacacacacacacacacacacacacacgcgcacaaagctttgctggacgtaaaccccagaactgaagagaggcaacagccatgattcaaaatgagtcttggaattgacaagcatgctcttcttgaagtgagctcttaacaactgggccaggcccttcatcccaggtcacctttgcaggagcctacaggtttctttcccagtggcagagctggtgggtacactctttggaccaaggtcacctgagggctcttctgtccaaaggacctccatgcagaaaccctcagtctctgcctcggaagacggctgttctctgtgtttatctaaaacaataagcagcttttaatgggtgacctcgtcattttgccagtagccttccctaaacagaacagttccgtcctcttcttaatcccactgagcaagggagttttccttagcctcataaaagagaaatattttgtgaaggaaaagtaggactcatgccactttatggaaagacctgtgttacacaaattcacatgaaagacacattctaggggaaatgtgaaaagccaccaaaagtagaagcagacagatgtagtgtgaatccacctgtcctacctgtatgagctcaggaaattaaatcttctaagcccccttaatttttttttttttttttttgagacagagtctcgctctttcacccaggccggagtgtagtggcactatcttggctcactgcaagctctgcctccttggttcatgccattctcctgcctcagcctcccaagtagctgggactacaggcacctaccaccacgcccagctactttttgtatttttagtagagatggggtttcaccatgttagccaggatggtctcgatctcctgacctcgtgatccaccctcctcagcctcccaaagtgctgggattacaggcgtgagccaccgcacccagccctaagccccctttaaaaacagaaataagaatatcactcaaaactgacataaggattaagttaaatcacatgtagaaactaccttaagacgcactatgactgtcttaatgtctaaaaggaccaaatgaaataattggtgattaggtttaaaggctacactgctctgtaggcaaagtcctctttataaatgagataatatatacagtggagggggttcagcttataggggttatagacactttggagaatttaaaggctgttaagacctgtatttcccaaaagaagcacacaagtcaacattctaggtgcaatagcccatagatgccatgaagaacacctgtgggctgctgcatggagccaaactaagaactcatgccttgggcactcatgttggcacacccatcctctgtctgcaggggagggtgagacctgttctcctttttgtgcaggatcagtgattctaacaggactcaccctgagcacagcccatgctacagtccatatatagatgagggcatggtagagcctggcacccttgccataggtgagtgcttctccccacccagacccataccacatgttagggcacaagtccaactgtctggtttctttgactacatggaaaaaacccaacaggattgaatgcattaaaaagcttatatcttctcactggagtaattctctcctttgtgattgatgataaaaatagctaatgttttttaagcgcttaccactacacacctggcgttgtcataaccgcatgaagtgggtttggttatctggcagtcagctgcatattgaatggtttaaaagtcatgtgctgcaggtctcccagccagtgagtggcagggccaggcttcaaatctgagctcccccaaccacaatgccacatcttctgcctttctcttcccggctggctcagacgcactgcagatctcagtggactggcccttgtggtccccaccaattgctcagccttcttctttctgtttcccagccctgcggagccagctccaagaagactgccccctgcatacaagctgcttcctgcttgcccacatttctgtgaatccataacgtacactcccaatgctgtaaagtgttgtacttccccataaatgaacatgcacagtcttcaaagcctctgaatcttccactctattaacttgttgcttcctatttcagataagaaccagcccttttgttatattttaatttcaaatatccactctccttatcagctggcccaccactgtcctctgaggctccagctcaatcatttgtggtggctgagcttccttatgtacagccaggaaaatggagctgggacacaataggaggaaagttaaggagtgggtttcaattatacttgaaacttctcaaactgttgtctcgttaagtttcagtggaccttgaaactgtgtttatgtgaaagtttttggaacattcagcatttttaaatatacactgtaagtactttaacagaatgttgagtggttacagacctgcccagaatttaacctcccttcctcccagtgtgacagtttctgttgcccttactttttctgtgtcctcatcaatatgttctgaccctgcctggtgaccaggtcagcttctggtggctccttgcattaacagtgagactttcctgatgctggtctatactcagccacagcagtccaacaagatgggccctatgacaggacaccaagactcttctctgcagtacatccagcagaggggcaggtaggagcaggcaaaacaggaatcagcactagacattcagacccccaaaagagagagacctgaggagagggatgcacactcctgtacataggaggcagaacagatgggtgctcgacaggtgggccgtggagtggggaaccgatcaggtttgaattctagttctgtcacttacttattggataaccttgggaaagccccaaatgtgtcatgtgtgaaatgggggtgatgacagtccccatgttgtaggtcgttgtcatggtgcaagggccatggtaagtgttctgtgaaaatggccattacaatgacgcatgacccccaaagaagatgcaggggaaactgggcaatgcccacagaccatcccccacccccagttgaagtggcttgatagcactgagccctgctctggtcagagctcagccccagttcacccagccagagtgacacccacctgagggcaccgtattccagggccacaggctcctccaggtcttcccattcactcccactctctggggactcttctggaggcaaagactctgggacagtgccccaagagcagaactgtggcaagggaatggtcccagaatctgcctccaaacattcttcacagggtagctggccttggcatgtagagttgatggtaagatactcttcatcctccgaggtgggagaaggggctccacatggatggtacatgtcaccttccccatcctccccatccaattcaggactagaatacagaagcccatgtttcttccagccttgataaaaaaaattcctcaccccaccttccccttgccttttagaatactctgcacgacacaggcccgtgagactcagccagtgttcaaacagctcatgccagaggctgctctgggcaccaggaagcaagaaacttataaggcaccaaccctggctttgaggagcccccaatttaatgagaagttggagcagtaaagaaatgttacagtccatgtaggaagtgctatggtagaggcagctggagcaccttaccgagctcaggagaccaggggggtgggggggcttgccagagggcacagcattgcaagcagggcaatgacccagttctaagacagactcgtcacatggcaagcagagtcggtcagactttggacaagtttattgacttctttggaacctcagttttctcatttgacaaaactagatggtcaagaagcatctaggattattgggacacgtaaattacataattctgacacagcccccccaactctgggttcctggtatggggtaagtttttagtaaatgtgagatgctgtgattagtactgtgaatatgatggctatttcaacagaagaattataaagaaagggcttcaggaagggattgggagtgactcaagcaggcaaccatcaaagcactttgtgcaaagatcaggtccttttctgagcactgaaaatttgcctatttagagatgcggcaagctgaagtgacatttactccccgcggaaggacacaggaggcagacaagtggtgaagctcattatctggtgatgcagccgcagacgtaatggtcaaagaacaagacttccaggggctgccccaagttcgccacacacgcctcttgattagaaagaatagtccatgcaaaggtagggcattttacacagcactgcagacatgcagagaaggtgctcagaaaatatctgtcgaaagtctggttagaggagatgagaaggaatatctaagagaaaagcacaaagatttagcaaatacatggatcctcatttctcagcctccttacccccacccaaatcaatgggttggctttgttatgtgctgctgctctccttctcctttcctgcattgcctctttctcttaaaattggctctggtgcaccccaatagctacaaacccttagatacccagagagcacgtcctcctccccagtagagccggaagcatctgtcccaaactgagcttcactgtgaaagagacattatttccactcatgagagctacaaggtatgtgaaatagtgaatttcatgtaaatatatgcacactcaagtgtataaaaaagaaattattctacaaagactgaagaggaacactcactgtcaaaagacatttttaattcttgagcatttgcagggaaaattgactttaagcttggctaaatcatgtagaaactgtgttttcttataaacatgggaaagaaacattcaagaagttttatcaaagaatgggaaatctagcctattgcccaggcctaggctcaccactgtccccaccacctcaagcagcacccccttccctcctttctgagctcactaagccttgttgaggagtggaagatggcagctgtatgtgtccattggccactgcagctgcctcagtgtccacacctcacctcccacccatagactccctccacctcttctaataagctccttgccctctggttttgattctgagctccagctactggctctgcctggacagagacctagagaagccatcagcctgagaggcaagaggcaaggcttcatctgaggttcaaccaaagaaaaagcgatttgctccccacttgtccagggggacttggtggtcccaagggtgaaatcgtggccatcatcccaccacaagttgggagaacgactgcctttccttctatccttttgcacgtgccatcaggctgcccttggagatttgacctggggctcaactgtggacatagggaaagggtgaatagggaataaagaggcaccagaagcctgtatgcctatttcacagaaagggcaagacttggaaatttggagaatttcattaagatagagacattctttcacagcaagcctcatgttttgcatgtggacatgatgggtaaagaggtggagttcttcacccagggttcaaggccggccagctcatggctaatgtagcaggactttcagcaagaccctgatgctgtcggagtacacggggctctctgctcaccccctgattctgtgtaatgatctcagcttcttcctgccctcactctctgcccaccaagctgtccaacagaaggaggcttttatagacagatgataactagaggagaatctggagatttcacttgggcttcctggccagccatgtctcccatacaaaccagcaggaccccagaaccagggtccccaccaagtcctgaaactcttcagtgggtatttttaagaggaatcccagttcagctctgaagtcagtgaaaccattctgaaggctctgcttgctacagaatgtttactgagaaaagacactgtgcccaacttttctggacagctgtcctttaaagacttgggccaccaaattcatctctgcctttcaggaggaaattcatagaagcagattgggcatttcaggcttgaaatatgaaggtattataattgtcctatttacttacggttaaactcacaacaaagtttggggtttgtgtcccttcatgtctccagttctccaacatcaggccccatactgatgtctccattagccctgatgacacagctgggagccccaggtctctgctcctgacaactgcatttagttttggcaggttggatttacagtatctctaagacatcaaagtaaacaagttcaacggactgccagatttgaagctcagatgataaatctgagctgaagtacaatacttaggatttgtcacagtagtgtggacagatacccctgggtatctggggatacccaaggatagccctgggagcctgtaaggtgtaaagagaatcctgctagaggcagcatccaggatctagcccaggctctgccgcctccctcactcccctcagccacactccaacccaagagcaggcatgacatctccctcacctggcaactgcatccctccctaactactctgacatcacacctggcctggcccctgcagttgagtgagatctctggcctcctaattatcttttgctattccaggcagtgcccttccccagaaggtatatcataactttaggttcatttccaggagtcctgcttcattttgctttcttaaataaatgaccatcaagatttataccatcactttcacaaagtgatgcttgtggaacttacgtgcattttacttacatgagtttaatgatatgtgctaggcaaaaagagaaagagaaagataaccttaaacattctgcaaagaccaactttccaaccgataagtgtaagccttgaagtgcacatgagtgggagaactaaatctttcatcctgtcaatctgtctctgtttctattgggccagcatttaaagacaaacattttgcatacagcatggcccataaatgcaagcctcctaacttcatctgaggctcgaccaaacaaaaagtgatttgctcccacaccaaggggcaaataacatcactccttccaaagtgatgtttcaagggtaatgagacttgatgtgattgttgccttctgcctacctttaggaactaaccttataaaaaacatgtctccagccaagctttccctctgataggcacgtaatccaactctccttcataaaaatgtactgtactgctttattacaagatatttttataaagatctactactagatggtaaaatctctagatatagagtgtgagaaaagagaacagggaaagaaagtgaaatcgaatcttgtccatgaacactttgggtttgctgtggtgctggcagccatctggctgtaggaaattgccacctggcagatggtaagttccggcaatttgctgggaatttcaattgaagggacctgttctttagctggaaatagctcaggaaagggaaggaaaacagacttgcattgagttcttaccgcatgccaggcactgtgacagcaccctgagcgtgctatttcttttgacctgcacagtaccctgtggaactgtcatggtccccatttacatttgggaagcctccagcttagggaaggcaacgctccaggcatactagtaagtggcaacgctgaaaccacataataggatacagaaatccatgctctttttgttgaagagtttaactcacagatgccagacacttaagaggcagtggcctgcgacagtcacctcagaactgagctgcaaacacttctaaggcttctgcagagtcacaatcccactttggaatcctgattcagaccctatccaggagctgggggaactgtgtccaggggtcgctgggcatgcgtccctcttttcttcctgtagggggcagccactatgtgtgcattaaatgcaaactgacgtcctattggaggagaggtggacttggtttgagttctttcagaggggaggaaaggttcctaagtgagggagggaaaacgaagtaaaaataaagccaggaaatgtgatgaggcagaaagcattcatcaacagaactaccacagggaggcaagagaaaaagggggtgcggttggccattgagagagccaggataccgagaacagtaaagctgcctgcccacagttcatccatgggtacatggaccatgtgggcccggcagtgagtatgatggttgatgggcgttcacaacagactgaagataggagactcccctggaatgctctggacaagcccttgggactctcgtgtggctctaaaaggagcagtccctccaagaatgacagattttggacatctggtatacccttgcaaatagggccactaagccaaatttaatttggttcagaaaaacagaataatgtgatgtttgatgaaaaaaaaaaaaaaaacagcaaatgctaacagataggcagaaataggtatccggacttggaagtagaagacataaagaggcataaagatgtggaagatgtgggagcaaatcactttttctttggttgagcttcagatgaagttaggaggcttgaatttatgagccatgctgtatgcaaaatgtgtaactttaaatgctggccctataagaacagcataacagcataaagatttcaccttaatgtaaggaagaaccttctgatcagtaactagatgatgataaaatgggtcattcaagaggtagcaagttccgcatccctgcagatattcaagcaaaagctgggaccccttcttcaggaatgttatggagcagattccagcatggagtttgaggctagactagatcatttttatattgaacaggctgattttctgtagtttaatgaatgaaacagtgactgcctatactaatagtttaaaataccattttaaataactattggctatattaaattaaaggcacttggcaagtcaaattcccagcttgtacctatacccagggtcactttataattcagctctcagggtccctgttcattatcccaagctatctggcagcaaaacctttcaatatccaaacaagtgcctcctccctacaggaaagtaccgttcctgtaatatatcctttaagatcatggtaatagttgtccttggacaagtctctgtaggttactttctttattattttatcaagtatgtcaattactgcctagactgcaattgtaaagaactataaatacacttatgttatacattatcagacaacgaaagtgaatatcattgatgaatgtgcttgttcaccctgttctactttgcaaaccagttagcttttgtttggctgacacagcattcttcaaaaaattgtagcagggtacttttagggaatgcatgcctggctcctgcttgtcacagctctcatcgggtccaacggtattacacgactgcttcacacttcacagagactatcatttcctatggatctacctttgacagtcgtctaggatggctaccaaatgagagccatttaatctcagtgggtttatagagtgtcaaacacaaacaattgccccttgttatttacctgctttgtgcccatgcctctggctggcaaatgctagaagcaggtcttaccctacatgtgcagccctctgtctgctctcaacaggtttccaagcaccttgtgtaataagtacttgtcaaactgaatcaaagactatgtgttccctcagcataggactgagaatcggaaatacttacagatggatggacacaaaaatgcagactaaatttaaaatgactgtgaaaatgaatgttgcagggtggtcttgaagatatagatgtgttcagaaaacaaaagctggtgtagccaggcatgatggctggtgcctgtagacccagctattgaccggctgaggtgggaggatcacttgagcccaggattttgaattcagcctgggcaacatagtaagaccccatctttaaaaaaaaaaaaaaaagctgatgttgataatgaagcattatactagcaatagaaacgaggatgcatgtaggaacttccttcttactacaaagctttaacaggccatggaagatacaagagaaaggtttgtgtgccaggagaaaacctgaggcctgccacctatagcttccaagacatattggggacaattgtggtctgggtagggtttgctttcccaaaagctcacaggtggtcacagcagcaccagaccttatgcttctcttgttgcaacctctcttctaaatgcctggaacagtgctgggcacaaaatcatccaagcatagttattgatggcttgattacaatttcctagcaatgagatgcacatagtttacaaaatgtctgcaaatgtggtgattcttaccttccaagtctcatgatatcacaaactgaatagcagttttgcctcacatccttttccaaagaggtcgccaatgttgattcatccctttcttggtgaagtttgcataaatgagggtgggactcaggagaatgtgtcaaggaactggcccaaggtctctctctgttttggccccattgtgcctctctgatggccttttgggaagactctggcctgagacccaggccttcccctgcatctggggaggcactgtccctccagctgtcctcttgatccaggatggggctggtacatgagtcagtacatgttgccctggtgaattctttgtcagctgagagttcaggtgtctattaaaagaaatgctactaattactggctgcgggatgcacattgtttttttaaaaatacaaagcttttttcccccatgtgattatagatcagagtagttacaagatgggctttgaggtctgtctatcaccatagcatcccagctcctccacatgctcccagctggacactgggcaacacactcaggcaccttagcttagggggctttggaagctctccataaatgtgagccttatttttaaataaaaaatatttgcaaaatttagacaaagataaaaatggaagataaatatgcaaaacaatgactctattccactttccgataagaaatgtttctttttaagtttttcatcttcatctgtcatctcagggcttgtctccctgtctccacccccatcaaggtgatgttctttcctgggtctcctcctcactttcccagacatgacttgcttcgtctcaactgctcacctccctgtcagccttttaggttctggttttgatgatgtgctatgtcttgctgccactgcttgaccttctacagaaaaacaatctgtgtttcagtagaaaactgtttttatctacagcagaacttgctgggttctctgattctggctgtctccactgtctttgagctattttacaactctataaataaacaggtcctttgaaatctcttttgagccagttttaacatctgcctggttccctcactgaatgagttaaataaaatctttaacgtgttcatttttatatctgtaggaatcatgattttaccttttcctgaaaattatcttccagcacttccaccccatgatctccatacctgatgtaatagagcccatgcctgggttcccacccctgccctcacctacaaaagaagaaccaccccaatgagtggtctccccacatttctgattgtacatccctaacaatgagagggatacacctccaaatgtgcacatttatttaattataaatcataaacatttactactcttctgatagactggacattataaaggatacaccaaaaatcaaaattttaagaagaccatattttgtcacattttcatactctttggagagacctccaaaatctgttttctaacctatcctctccttctagctcattatccctggacatgctctccagcaatccttccccactccaagacctccagtctgtggagctgctgcttttcatcattacccccactccccttccctgtcacacatgtcctcggtgtgcctcttattctgcttagattccatggctctgcccctagatgctcacttacagacaaggaagaccctgagctcccacctccttgcccctctcttcctccatcacgtgtcacttgcagattctgagtttccattttaattcctactcaaactgtgtgaacctcacccctgcttctgagcctctgactagattagcttcaagtgtgtgactgcagatgtcaaatgggcagtcaagacttccacataatctttgtctgtgtccttaatcaattcagttttctacctctgctctctaaattatttctcatcttgtctctctcttcaagtttctaacaactccaccctgaccttgcctgtgacctcacagtgagaatggacacgttcagatgagaactcttcatcttcccacagcaaattccactgagcagcctgtgcccctaccccaacttcagcttccacctctcaccacccatttctgtgctctacttcatggcagcctcttagatgagtgtctcttctcaccgtttccacgcctccctccttctttcttgcacccactagcaccagccttctgtccttaccacccaagggaaggagcccacatcagggtccccagcgacctctatctttctaaagctgaagaacaatattttgtcctttcactctctctctcagcaacgttcaacaaagtgtgtccctccctccttcctgagagcttccttgctcattagccctacttacatggagttgaccatgagccccacccttgcttggtttttccaccaattcccaggccccatcttaatctcatatgttgtcccatctctgtaccaggcctctcaatgttgttatgctctgtgctgacttctcagtcctctccttgaacttatctgcactctttcccaaggtgatctcaaccatttcatggctttacacgacctctatatatgctgacaactcccaaattcacttttcccagccccgatctcatgcctattctccacaactgcctaatagactcttcactggatagcctataaacatctcagttttaaatgataccaagaactattgtttctcttccatgcaccccagatggccttccccagcccctgtaagcagtccctctcttgggaactggtaccaagagagatgaagtggaaaataggatctatgattaccctcctaaagcatgaaataggtatatgtgatctagtgcaaagaagagaggtattggaatcaggaaaatcaggctttttaccttcttacccctccttcaccctgcattggtggtagcaccatttccccaaggcttcctcgtgccaaagcttgattgctctctttcctcatgcctgtttctaatcccaaagtagtctcctgaactccgcctcccagatgtatcccaaatctggctgcttcttaacacttcagctacagcctgagtccaagccacatcatgtttgacctgaatgactgctgcttgacctcctttagtccctgtgcaccagtaacccgagtggcccctctgaagaacggaggagggcatttcctgcttaaccctccatgccagcccagtggcttcccactgcatgcaggatggtggcatcatgctcctctgatccccaaggccctccagggtccctgccacctccacaacttcctccacttctgcttcattaacgatggcccaagcacacttgtatttttgtccctcaaacatccaagtgggttcccatctcagggcctttgttcatgctgttccttctgcctggaatgcccttaccccaaatgtgggcatggctgcctccttctcagaggtgctttactttatggactaaatgcttgctccccagagctgctgacccttgttctgcaatctgaccactggagccacccaagcaaatcacaatcctcccacttggccttcgggtatgaggagggaaagctcacccccacacctcacctggacccttcctgctagatctttatgggctctcctgggaggagctattctccaggatggaaataccacttttttccctgggatttcctagatatttcaacaaaaacacagggtcccagcaccttggcctgaatttgtgtgtgtgaaatttggccctctctcacctggttcggtttcttaacacaattgctgctgtctaccttcttttccaacccagcaacttttggatatctttcccatagctcttccctccctagaggctatgtcaaatgacctcttggagtctaagcatcaacaggatctgggacatcaagtcctttatgttgtcctagtgatggtgtcaccctcaggcacaataagtgatcacttttatccacatcctagagatgaggaatcatggggcctagagaggacaggcaactgcccaaggcccatgcagcacagcaggtacaggtgatccaggtacccgcccagatccccctccaggactgagattcgcatcctactgcctcatctcccctcccctggggcagcccacaccccagcgctggttagggcaacaagcaaaggcacaggttctcttgtcccaattcatggcagctccaaggggccatctctgctccagggctccctccagaatcagctgaggccctgtttatagctgcacattgatctctccttctgccccaccccacctcagtcaccctcacaggggatgttctcaagcgcaggccccataaaacctcccacgctcacatctctgctgcaaaatctgtttcctaggaaccccacagaaggcatggcaatgggtaattgtatctgtcaacttggctaggccatggtacacagataggcggtcacataccatctagatgtcactgtgaaggtatttttttttagatgtgatttgacatttaaatcagcaaactttgagtaaaacagattgtcttccataatgtagtgggcctcatgctgtcagctgaagcccttaagaggaaagactgacctctctgaggaggagggagttctgcctccagaccacctttgggcttgatctccatcaattattctctgggtctccagcctgctggcctcccctgtagaattggactggccagccctcaaaatcacatgaaccaattcctataataaatctctttctctcactctcttcatatataaacacacacataaacacacacacacacacacacactcattctatctgttctatttctctgagaacctgactaatatatgtgtcaaggtaaaaatccctattttcctgattccaatggctctcttctttgaaccagactgcacgtgcctatttcatgctttaggagggtaatcatatatcctattttccacatcatctctcagaatggaaattcttattggaaattcccttggtctgcttctgtgtctactctccttcttcccaggcttccctctctgatgcctgagcttccagagagcctggccctaaaagtttcacagccaaagtctaaacatgtaaacatctacaagaagacccaaatgtcagaagaggcagaatcagggagaggaaggagacctactgaggtttgggggccagctattttcctacccctgtgaaaggaggtggcactgaacctatctacaaccctcttaggaccctagagtctggaaaaggggggcccaaccagagccaggtagagagagtagaagacactgcagcctacctgccattcctgctccatctcaggcagcgcacctggagggggtcggcaaaggaggagcgtgacttcctgtggggcccctctcagtaaatgcagcacctcctgcgagaaaccaagattcactgttagatttgggcttgcattgctggggatgcagtgatgttctccccactgcgtcccaggcactagctcctcctccctgcaccttgatctatttctcactccagagaactccggagaaccctgctgtgggcctgacttttcaaagtgcaaggaaccaaggtcagtggcctgcagcttccacaaagttgatgcaagatgctgggctgtgcatcacctttgtgcagcttgggttctgggaacctctcatctgtaatattgcagtaacctcctctccgctccctgccttcaccagtgtcacccacctgcctccttccacattgctcaagggaatggcaatatctgccaataccaatgccttttcttcagagagagaaagaatgactccaacaaatagctgttcatctcaattgccctttcctcccaacctgccctcatcttgggccaccaattttgcagcctccaccatctgaatctctaaagcctgacccttggctctgagcttcctatcagggctcggcttgggctctgggaacctctcacctgtagtattgcagtgacctcctcactgcttgctgccttctccagtgtcacccacctgcctccctctgcaatgctcaagggtagttttccacagtgcagatataactgagtccttcccccactgcacaccctggctgactcacttttccctcaatgtaagctccaaggcatagcacatagaccccgtttctgcctgcctctgcctctcaccacagttccctctctcccatctactcccctctgcacccacgtcctaagcccctgccatgctgaatctgttgctccaagccaccctctcaatgtccagggttcaaggttgcctcgatagctcctatttcctatttagaccaggatttctcaaactcttggcactgttgacctctcaggctggacaattccttatgcgaatgcctgtcctgtgcattgtagggtgtttagcagcatctctgatctctactcactagatgccagaagcactcatcagttgtgacaatcacaaatgtctctggacttaatcaaatatcccatgagaaggaaataatctctgcttaagaactgctgatcaagacactccccagtccctgcttcagccacgcaggacttccaaggggtgcacttctttcctggctcactggtgtgagcactgcagcatgggctttcatctctcaggatacatatctcctgccatcaccgctgttttctgtccatgagctctgaaactgcatgagctgtcttcctctgtgtcttcagtctctcatagagttgccagcccagcagtggttctcagagaagggttcttggatcaggagatggatggatgaaggcatgccctcccacccaagcatatggtgttctagagacctccccccagccctgcccagagccactgtccccctttgtccatcttgctttgtgtttctggagctgacttataaaggctgcatgaggcttcctgttgggctcagctaggggaacacggcaagagaccagagacagggaggagcggaggtcattgctccttccaaattcctcccttcaggttgccatgggacgactacaacctcagccaaagtgagagctcatgccagcgagtcccctccaacagctctccattcctggggtggaataactgctctttcccttcccctttggcctcaggataggggtaactgcatcccactcttcctatcctagccctaggccacaacatgctcccttgagcttcctaacaacctgcccacacctttattaaatgttcctcaaatgactccattttcttccaggactctgtctaatatatacagtatttcattactctctcttcttaaattgcattttttatcatagacaggacaatcagtgtaataatgtatgaaaagctgtaaatgtgttgagaaatgggaaggagagcagaaagggacccactctagtcccttcagccccacgcccacctcccaggatgtgtgtgaagagacgtcagccagcacaaaggccagggctttatcttcagcttctctcatgaacccagtgagaagcaaggctgactcaaggtcagatatttaaaaacagagattttaaattaaatgtgagcatgtaccactaattactctctttgtgtgattaaaatccgggctgctggtgtgatttttgagagcccagagttttccccacggcagcaggctagtaagaggcaaagctggggccagcctgcacagagagctgcattgcccatgacccccggcacctggaagatgaggccttccgtggaccttccattcacggccaggataatgtcaccagctgcaatggccccattctcctcagctggctgccccggaaagagcctcttaatcctcacaagatcacttttgagatggctgcagctctctttctccatctgcacgaaactgaatcccaaaccattggcattcttttttagtttgacttcaaacttaggacctgtagtgtgggatgttgataaaaataaattcttcagtagattacaagtgaaattgaccagtctcaaaatgcagattgtcaagtagatgaattatttcttttacgttcaaataattcctttgctaattttatgacagagtacattatgtatgttatagattagtgctgtccaataaaatataatgtgagctataaatacaaaccacaaatgtcattttgaagttttcaaatagctacattaaaataaaaggaaaaagcaaacaaaaaataaataaaacaatttaaaaagtaaaaggaaacaggttaaatacgctataatcgtacatctaatttaatcccatatatctaaaatattaccacttcaacatgtcatcaatatgaaaaaattattaacgagatattttttattcttcttacgaactaagctttcaaaatccaatacatattttatccatttagattggtcacatttcaagtcctcaataaccacatgtggcaagtggctaccatattgaatagcacaattatagataactcaactatgtttatacataaagatatagctgctaggcatacacaacatgctcttggcatttaataaaacttgtatcacatacattcctattactcctttagaactctagtcatttgtagtatacttgaaactaaattttgaataattagaccatggagaaaattatggccaattctatggacaatgctttagctgccattttgtttacccatgtaggctgaccataagacaaaacagttgcctctgggcaccaaggatgaacagagctggcaacctacatggtctgtccaccaaagaggcctctgggctgccccgctggcatcaatgcacagagggacagagcacagcttgcaaacttcaccagggcaagaatggaagcatgtgaagcaattatgtgaagcaattatgtgaaggtgtgtcacacgaccagttctaccatcgccctaaggcctcctccactctttggagtccatttctcaaaggccccaagggagtgagcaaaggggtgaggacagaggagacttgatttaaacagaagcatgcccctttgccccacccctaccctatggctggcttgagtcttctgcagcaaaatcagaaaatctctatgaagggactaaaacatggctaaggtccaaatcgttcttactgaggaaatcagcgtgttcctggcaaataccaaaatcacaagggaattgcagatgggcagcccatcggaaaacgtgcagttttgtccctctaaatgatcgttcgtttgccttttaaaatgatgctaataacaaggctagattcctgaaccttctctcccaacctgcctagtcattcctcaaataactttgttacaaatgacttggctggactgtgaagccaaatgtatctgaaagtgtatgaccctttcagtcaatttcatcctaaatattcacacaaacattaacattctggcagctgatcaaaggactgaggaaggctgggggcagaaagatgcctagaaatcatttggggaaaatgcatttgtttccagaaacctattccatgagatgggcttccatggcatgaaaaagccgatctcagcatgatcaccatggctcgctttcttttcaggacccagaggaagccttcctgcctttcccttttgacttgacaattcaaaagcggcacacaataacatgacaatagtaacactcaattctctcccctctcaccatctgtcaccgagacacagctcgaaggcctgccaggcaaggctgttaccaaggaaacagccgtgcgttcatctcccatgctgtcattagcagaaggacactgctgtgtactcctggggactcttctctctaagaccagtcttgcaacctagaaggaaaggtgaacaaactcagtttacacttcatatggcaaccaggaggcactcccttgactctgcaaatgcttcttaattttcgaatccttcctataagcagactcatttgaatctctcaactagcctatatattgggatctagacccagatttctcagtgcttattagacaagtgcacctgaaagcaacacatgtacctccacttcacacatgcagtgccacactcatcttcctcccctcactcaccctcacttcccctcctcattcttcctaaaacactcctcccctcgcattggctcaccccaccattaacctgccaagggccacatttggagtggtccagctctcccccatctggtttctaagatgtgaacattccccatcaagaacagctcctcagtgccccctcccctccacctcctctctcactgccagtgacccgctgggccgtggcaagctctggttaccttggctcgctggaccctgtctgcaaccttcttggtccaccccatcatggctgccagtgaattggtctaagacaaaaactgaacatgcaacattcttgatttgaagtctccaatgcttcccatcacctaagacccaaacccatggcaccccaggtctgtaccacctgccctcccctttctttccaatgtgatttcccacatttctccccacaacaccatatacccttgtcgccctaagtgtgattcaagaaccagcagatagacatcacctggaagcttctcagaaatgccaagctcccattcagggcatgtggccctgccttcatcttcctgttgcacctgtcactcagcacctggcccaggatcccagagggacaattcctacctgcttaagctgccaggaggccagccaagtaccctctctacccatgctcattagcaaaggtctaaatatcagaaggtgccaataaattatggctctgttctcaagataggtcaaccaaagtcactaatataagcaaatttcaccagacaccagaaaaacgctttgggaaagaaagcgaaaagtggccagaacattgccccaagcttgctggaagggccttcaggaatccctcctgtctctgttgactttttagttgccaaaagagggtgatgccagctctgtggctcaggacacagaggcagttagaggctcctaacctcaggcagaggactcggcacagtgggataacatcgagtcactgcggggcagggaataaaggggacataaaggatgaatggctctgctcttggcaccctgaattcctacctcattgtgaggaaaagaatcccaggacactctgacccacgccccggtgggtacaacacagggtgagggggaatggcatgaacagggaatggagtggggtcatcccatgcaaacgtagggaggtaagaaggcccatggtcacagggccagcggggctggggcagccagagccaggctagagcagtctcttcactccatcttctccattccgctgtctgattccagaattcaggcaagccaccagtaagtttctaaggctatctatggggggtgagattttttttactcagaaacatctatctgctatctcctgggtttcacatccccatagaaaagtgagggtaagaagaaatggaagagaaaaaaaaaactaacaaagaaaaagtcttgtttcctgcctgcctccctcccacccagaggcgatttcagcttctgatgttgttcaggaaagttccggaaggaggggaagctggtcagcaacagtccactcacctgcccaggacccttcaggcactgcacagcctgcttgtgggtgaggccgcacagaatcactccatccacctgcaggagtcggtcacctgggaaagggatagatgtcatgtcatgacctggtgcttgaggctgcaggaggttcccttccaggaggaccctgcccggcacccctccatgcagcctggagaagtgggaaaggaagctgaggtgccaggtgtccccctggagtcagcaggaatcctgcctctctgagcagtctcactcccttcttctcaggcacatcacagatcagggatataaaagcctttctattattggctcacagaatggttgagccagctctgttcaaccttatccttcctcctgttttcctgtgaaaccgtttttgaaagtattttcaagtcacttagatatttatatctccaggatgtattttttttatttcaaaaaaaggtcagggaggcatggttgacgctggggacaccagaattctaggggaaatggagataagtaagatcctaggttccccttttggctcaattctggcagttttggagaccaataaaaatcacccccttccatcagagaagtgggagctgagcaagggcaaacagaaggctcaggtgtcctccccggatgtgcgagtgagtttaccgaggcccacttgtcctccaagggaagcagtatgttttcccatggaggccaaagagcaacacaagtcttttaagtcttctactatttttctatcacctatgcttcccagtgtgccactgcagaccccccaacctatcaaatgggcagggcagattctatcacctcctttccaggtgagaaaagtatgacctggggaggcaatcatttgcatgagttttcagaatgggagcagggcaaggcctagaggctgcccctcccagtgcagggctctttacaccatggagcacagagttcccaatgaggacccatccccatctctcaccctgtaggatctgcccttccttggcagctggtcttccaggaacaatggatttcacatagataccaccatatggcacactggtgttaatgccaccctgaaaaacacaacaaaaaactcaccacccatctttcctcctccaggaagcctccccaacctccccagctaagggaatccccacctgcccaccactctatcccatgaccttacctccgactggcactgtcttctgtattcacctgtttgtttagattgtattctccactgagcaataagattaggtgttcataagcttaacaatagcaactatgtgagagatctgggcatgtccccagcccaagcactggtacaaggcaggtgctcagcaactgctcacgtgggatgcaccactatctctatataggtagtgaccagcgtaggtggatatggctatgggcctgaaggcttgtgcctggcacgtcttgtgtgctttgatgggccaaaggatatgtgcatttttcattataatagatgttgccagattgcatccctatgtgaatatggatatacttattcacatttctaccagctttgtatgacagtaccatttttctacgttccaccagctgtatttggccaagctggtagacataaagtttaaaattttattttaatttaatttgtattcctgtggcttttcacgggtttgagtgtttttcatgtgtttaatggccatttggatttgagtgagacatttcaagaattatttttgaaattaaatatctgcaaagaaaatccaagtttttgccagccaaaggaaatcatcaacctcttctcagcaaatatatatttgtgaataacccaaaatttagtcagtttttcagatgaaaaatagctatgtttggtgtctgataaggctgttaccccaagccaagaataaatggaccatatttggtatcagcctgttcactccatgtggattcatgagccttattgcttggtttcttacttggtcccttaaaatcatctactgatgacaaattcattgcaggcttagggtccaagaaaacacatatccttgctctaggtacatagcattatcacaggggaaagcaaagaatgccctccattcacatatctcttgaatttcctctgaaaattttcatcagccatagagtgtccttactttggtgggagatgccattctatttcccatcaacagttaaatccaacaatgacattcctgaaatccagacccattccagggtctgaaggtaatggatcacttttttttttttttttttttgagacggagtctcactctgtcgcccaggctggagtgcagtgttgtgatctcggctcactgcaaactccacctcccaggttcacgccattctcctgcctcagcctcccgagtagctgggactacaggtgcccgctatcacatccagctaattttttttttttattttttagtagagatggggtttcaccatgttagccaggatagtctcaatctcctgaccttgcgatccacccgcctcggcctcccaaagttctgggattacagtcatgagccaccgagcccagcctgtaatggatcactttcaatactcagtaataaaagcagcaccttccaacctctgacctctggattttcaccagttttgtgtgtgccattccccaaccccttgggtaaacacagttatatgggtaatctcctttcacaagggtctaccaggcagagctcagaaaccaaatggaaagtgtcagtcctgatggaggcctggccctgggatgtctgagccagaggctccacactgattctatgctggatgacagtggactgccccacccatccttggccagatgacagtggactgcccttcttacctttagcttgtgtccctgaagccccaatgtgcttctctctctctgcagtccagcttgacctcagagtcaggacacatcagccaactctgcccacactgcctcctcatgagtttggagtcccctagtgcatgccctgctcatcctgaggttccccagtacctctgtttgtctctgaactcatcccccagtgcaggcccccattggcttttttatttaccccttacatttgtgcaaactaagcacactgtcagaggttgccatctgggtggaatggccaccaggttctagacggacatcttgttaactgcttttcaagctctcctaaaaactcttacagttacgctgaatccaagtgtcccatcttctttaaccagttccacaaagtagatttcaccagcactgatttctggaggtgatggaggacaagaagaaccagcaccctgccataaacaaacaaacaaaaataaagatgggatgaaggaagatgtcacctcttggctcatactgctctcaggagcaggcagcattgcacctcagaaagatcatgagttttggactgggccagcaggggattcatttccagctttatcaggccttctgcatgtgacctcagacaaagcaggaggaagatgagggagtgatgggctgggctgatgccacttctaggcagagaatgcttgggtcactgttcatgttccgctgtccctctgcctagaagatggggtcttttgtcctatctgccccctttacttagtgctttctaatcaccatgaatgttagaaaattctaacgacacgcaggaaaataaacaagctggaggaagctgaacaacgaagcctcaactgctgaggttgagacctgaagtgagaatctaaagtccaccataccacagaggatcatctggccacaaagttggccaagagacccagaagagcctgcagcatctgggttgcgtcctacagcctgcaccatggtcaacgtggccttagagctcccttgctcccctcaacggcccccagccccaggaaaccaactctcaggtttgccaccaaagaagccccagcatgaaggcctctctgctctgcttcctgccagagaggacctaccagaggaaggcctggggtgaaggtttctgctctggaggccaatctgaatcccagctctgtcccctgctccctgagagagcttgggtgtgctcctttgctctttctgtctcaggtaccccacccataaaaggggttgataataggaatgatctcattgggttaccatggagcttccatgagctaatacatataaagtgctcaggacactgcctggcacacaggtaagtactcaattaatggcagctactatcgttgttcttccactggcctcctgtatccagttcctcatgggatgttctgtccaggtgagcaccatggccaattaggaaggcactgtcattcatggagccctattgcatgccagatccttgtgacagaggtcaagacacactaccccaaaatagggcaccttggcacattggaggaattggagaaacagcacatgagggaaggtttctctgaccttcccctgcccttctcttctgaagcaggccctaaaacctaggaaggattttctaatcttcccccgaagcagggcacaagaccctcaagtgagaatgccctccctatatctggaaaaatggagcatcttatgtgggaagacacagggactgagagaggaatctgaacaagcaggccctgctgagttcctcccaccttacatactcctgctttttgtcttatctcatttctccatgactctccattcttcatcaaatatactcagggagaactgtttcttcaggtcatttccgtaagaaggctcacatgtcacataaaacttatagtaaatacacgtggatgcttttctctcattaatctgtctttagttacaggggtcccagctgatgaagctaagatgagtagaagaaagatacgggttttatccccgacactgggcatagtaccttagtttccacggctgtggacagacatcattatctccatcataaaaagagaaacaaggttgaaagaggtgcaataacctgcctgtttcaaccagcaagttgtcccagcaagaatgagaagggcatacactcagcctgagtaagggaggataggtcatgggagacctgttttcaaaggtcttgccagcctttggagaaaccagtaatatcagttcagcacctggggctagaaacactgggtgctgtgaccacccctgagcctgaagggcgagagaagggagtggtcgatggaccctcataggagctgtgctctttgtagaggggcacaggcaacctgtgtcagcacagggagagagtggaatgaagggtgtgcaactgagactccagcactgccaccctgtcctcactcatcccacaactgcgggctcctgctgaggctttgactgggcagaaccaagcagaacacagcaaggtgactcagtccatgagcaccagctgtgcagggcccagagcagaatggagaggctggggcatgggtctggcggggcctgagaagacaacaccactgggagtccaaagagacggcagaggacagcagagctgggactgaagcacacagccctccatacacctactccagatcccatcttcttcctccatggggtatggtcaagagcaaagccactgagttcccagcttgaggaccaattcaaggacaagaataggaggtgcctgattgcccacgccttgccattggcagcaatcaatttcctcatggtgctattatcacaacaattataattagtgactaaagactccagaggcacccacactgagcctgtgcccagacactgtcctagaactctgccttcttctatgcgtttttctcaacaaccatgccatgcaggcatttgcttctgtatgcaaatgaggaagctgtggctcaaacgggctaagtaacttccatccacctgacatggaaaacagagaacaggaagggcctaggggccaggctgttgggcttcacagtctgttctctttcatccagatctagaaagtaaaccaagggatgattacctttaacggcagaaaggaaagctgatgtctcagcctgggcactaagctctgcaccccagccatgtctagttcttcagtatttctgtcctggtcttgtgtgtgtgacaacaaacttccctggtacccgaagctcaggatgtctgtagaggagaccccagaattggctgtgctattcttttcttcatctgggttatttccaccaacacctataaaaacaagccaagaaaaagtcaacagcttaaaaaggctggtttcttggtggcatctctatgtgggcacagcgttttcctccagtgacagagtgatcgtttatagctgctcgggtacaatatgaatttagctcctcctgaaagatgttacatttagattagagaaagggaagattctacatgggatttagaaacctagatagagcttacgtgacccaactatgaatgcgtaggctcaaaagaagttcataaggccagctatcccttattaagctctagccatgtgatgggcaccttagatatacatataggaagatatggacatcttcccatcttctcagcaaacccaccaggaaggtgtaatcccagttcaaacatgagaaaacagagtcaaagctattaagtgtcctgccccaaatgctacagccagcatgtgggaactgtcttaaacccagcctctcctggacaccccactgagcacatctgcagccaccatgtgatccaaaaaccaatgtatcaggtccttttgggaggcttggtaataaccaaactgcaggcccctgtgagtgaaagctaggccactgattcctgctcaccctgtgtctgactcgtgacctggcatagaacaaagaaaagaacgtgaggttgctgatgtttatacattttgcatgtaattactaccatagaattatacacttaaaaatttttaaatgatgtatgtatatcatattgaaattttaaaaagcaaacaaataggaggtgcctaagcttgactcatgttcattaatttgctgacccctttattatggcagtggttaatatattttagaatttaaaattcacttaaaatatgtgttaaaagacagattgctgtttccttagtttctgattcattcatgctggaatggtacccaagaatttgcatttctaatacatttatgtatgatgtggatgctgttggtctgttgatcacacttaaaaaacttctagactacattatgcctaaaacagttcctctgtctcatcagtgcagttgtttaattgatttgttttttttttctccaagtaaagagattaagttattctaatctaataacatgctaatatagtttggctcagtcaggcaaaatcaatcatacatatgaaatcattaacagctgaaaagaaatagagagagacaaagttgggaagagattaaaagtgagagctgatgtgggattgcctggatgcaactaacatcccagttccatcacctttctcctctgtaacactggaacaggtaatgaacttccctgagatttagattcccttgcctgtaaaggagaataaataacaaaaattcctcatagagtattttgaggattacatgggatactgcttataaagttgctagcaaaatgtctggtacataacaagtcctaataaacagttacagatgaaaaaaagatggacagggaataacattcatgacaaatcaatctgaaaaatgttgatgtaaaaaattctagaactcaggatatcttcacaaagtcggtgtattaaaataaatatggcataaaccctccaatgtgagccttataaaaagaggagatttgcttattatgaaaaagagaaagagtggagggtctatgaggtaattattaatattagttttattaaatattagcacatttcattaagtgtgcagcaacctcaagctggtgttattaactgaacttgggagaacatttgagctcatgaactattcacattgttctaaatctaagtaaaaaagtgataaaagagagagtgcagaagctagttaaaatgtgttttccatatatataaatatacataatatataaataaatatatattatatataaataaacataaataaatttaatatttataaatttaacatttataaatatattatatattatatataaataaatatttataaatttaaaagttataaatatattataattatatataaatatttataaatttaaaattttatataaaaagatataaatatatatgtaaatatataatgtataatatatctaaatataaatatatttaataatatataatatatctaaatataaatatatttaataatatataatatataaaaatgtaaatatatttaataatatataaatagattatatatatataaatgtagctaacagttccaacaatgttcaaataaggcaaaggcccagctgcaaccaatccagttgtttctgtacctcactttccttttgctgtccataaatcttcttccaccacgtggctgcgctacagtctctctaaatctcctgtaattctgggcgctgcctgattctcccatcgttcattgctcaaactactttaaattttatatatatatatattttacacaaagaataggctgagttaaatatacatcttgctgtttgcagtgaccattctggcttatcattacagatgtcttgttttctcctatagaagtaacacactttactacttttcaagacagattgttacactgattctatgattgtcgttaagagaaaaatttcaaccaaattaaatgtaaagtagtatgagcaatgaatgatgggagaatcaggcagcacccagaattacagcacatttagagagactgtagcgcagccacgtggtggaagaagatttacggacagcaaaaggaatgtgaggtacagaaacaactggattggttgcagctgggtctttgccttatttgaacatggttggaactgttagatacatttggccaaaactcagtgattggtacagatgtgggctacagttggtttacaacttcacttgttatagttcacgatgtatagaaaaacctttaggttgaactttaatatgtaaggaggcagctttaggctaaatttgatttaacaatttccctctttgggtcattttctcaatcttgagatattgaccaaaactttagttattgatgttactattaccatggctcttgaaacttactgggaaagagcagaacagtgagtttggcaaagatgggaacaaggaccgagtagagggtatgtccatatgttggaacattctgtttacagaagaaaaacaaaacctggtctgttctagaatctgtttgctatgttttccatgatcaaacgtagtttgattatgttacattcagcacaagcaaccccagttttgtctggtttggtctgttggggcctagtgcatgagctcagtccaaaacaatggcctcccataatttcatttaaaagaatccccttttttttaggtcatgttctcacttaggtgagagtgtgaccaaacttagggccttagcaccactctcagttaccatcattgtggatttctggtctcagcatgtcattcataagttacggtgtcctcatggctgcacatttctttcagctcttgtcattccagttaaagagagaccatttgacatgctagagatgtctgcatgcaaacatttaacacttttaaagagaatatagcacaccagaaagactattattatgactatcagtaggataataccaagagtttggagtgtgctccttacccggggtccccataaaccaaaccacccaaaattaaatagatcaaaggatgagctacatgaagagtctactcacttaactaaagagtctcggccgggcgcggtggctcatgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgaggcgagatcccgccactgcactccagcctgggcgacagagcgagactccgtctcaaaaaaaaaaaaaaaaaagagtctcttcattaatcccctacaactaaatctataatatgtgatgttttccccataggccataagtgccagcagctgtacagatacttctgtttagctagtaacttatccagatcaattctattatttagcataactttcacaagagaatttaaagtttattgtgtaaccatagcctttacagtagaatctgctttagagcctatcatgaggaatacatttttaatctttgccgcttttattccaaactatggaaaaaggacctaacaaatgatgcccttttagaagagtgaaagcctcccagcgatgttctccttaacccatgatgtgggttaagaggagtaaatcaatgttctgtttctgactgattatgaggcaatgtacgtaccattaaagtttctcatctacattgggccttcatttttgtctattaaggtataaggttatccatgtataaggctggctgcaaaatccttcacaaataaaagtataccccataaatgcacacaagagaaccctttcacttctattattcatagaagcataagcaagggacaaataatcaaagataagagtctcatgatagtagagaattcttgatccatgatcttgggaaaacctgttcacagtcaaggatgccatcttctggggagaaacccccctggttagcttttctttaaggcttctaatgggtgtacagttccaagagtgtaaagggagccttctcagttgtgagattatgaacccaaggttcaaggtcctgaagttttactgtagtgtgcatgccaatgacagtctttctttgatgttctcagaagatcagtcttcaggttctagtttatgaaggcattgattgtcctcagtgaaccataaaaaccttactttacctggtaaaaatacactgtagtataattatctactgctacaaagatggcagtggcaccccatctggagcagccactgccgtcacatcagctacagaggtgaaacatggtaaagagctggatacaagtgggaaacatgccccttctgagttggtggagttagagcttcctgggaacagttgcagcagcccaagtagtggctgcagatctgggcctcccattccatggagcacacaggacacctgtccttcaagatgcaactacagatgcccaagccacggctgcagagtcaggcatctctacactcttgggggcacaggaaaaaaccccaggcccttgcagacttggaggtatcttctgctcccattgcctggctcctccccactcttgacatctgctctgatcttggagcaaggttgtgggtaggctcaggtgctgttgcagcctggtgggtgtgcacatgcttgaggcagtgctgatacaccagtaccatactgtctctggcccctgcccaggctttgggcactgacaagcatgggagggaagctgaggagatgctgagggcagcttggcactggcctgcaggcatcctttggcacaaatagcctgggtgccatgaatggcagcaggaggcagacaggctcctgcacagaagggggtgggtccttggtgaggcctttccttcaggccaggatgggtgtgaaggctggggtctgggctgccagtcccgtgaaccagagtgtaaacttgtgatgccttttctggggccatccatggcctctcatggaccgatcagtgtgcatttcttcctttctgagacctataaaagccccaggctcagccagaactgagcagacattgggacaaccagctacagagagcagctacccactccagggcctcatctcttctgagagatgcagatattgggatgcccagctgcagaatggaggtgcccactccaggacatcctctgagttattctgtcactcaatatagctcctctttgctcactctccacttgtctatatacctcattcttcctggaggtagcacaagaacttgggacttgccaaatgacaggactaaaaatgctgtaacacaaacaaggttgaaacatgccccttgctcaccatgttgtggatgacaagaagagagaagaaaaaaagagctgtggctctatgggaacccagacctgggagctccccaggccagagctgtgactcccgctatgggaccctgtggttcctggagtctgcaagcttccaggtacaactgtgttcccttgtaacagccatggaagctgcttgtggtgtgtctggtccagccaaagccttatagtgagctagcactcatgctggcacctggagctgcctgtcccagctgcagcagctggtgtgcctaactgtgttaaaatatattgaacaatatgaacttccactcaccaagcctgacttgattgctcagtctaccagtagcagaggacaatattgagcccctgatatggtgacattccctggagtaatcggctggctgcctgggggcaggctgattacatggtatgaatttcatcatggaagtagcagcattttgttcttataggaatagacacttactttgaatacggattgccttccctgcatgcagtgcctcttcccaaactaccataagagacttacgaatgccttatacactatcacagtgtatcacacaccattgcgtgtgatcaaataagtcacttcctagcaatagatgtcagcaatgggcccacgcttatgatccaatggtcttaccatgttccgcatgactctgaagcaattggattgatagaatggtggaatagcctgttaaaaactctgctgcagcaccagctaggtggcaatgtcttgcagaattgggacaaattctccagaaggctgtatatgctctgaatcagcattcaatatatggtgctgtttttaccatagcagaattcatggctccaggaatgaaggagtgtaaatgagagtgacagagttcactattacttacctgtagtgactcagtagcaagatggttgcttcctgttttcatgactttatcatataatatgagatgtactgaatttgtttcatagtatttaagtaatcctaattttacatcatagtatttaagttaggggatatcaagaagagtaaacattactcaatgactttgcttcctctttctgggaagggattagtgcaatttttggtgtatacaggatagttgtatcctgtcaggcagaattatgaccttgctattgtgtttatttgaaaattaaatatggttttaaaagatacatataggtgccacattgacacagaataaacttataatagctagttttatgtgttggcttgactaggccatggagtgctcagatatggaaacaaatactattgagtgtatctgcaaggatgttctagatgagattgatatttaagttcatagagtgagtaaagcagattgttctctctaaagtaggtaggccttatccagtcaattgaagacctgaatagcacaaaacagttgattaagggaggactcctcttgcctggcttcctgagctgggccattggtcttttcttgcttttatattcaaatggaaacatggattttctcgggtattgagcttgccagcctttggactgaagcttacactatcaggtctggttctcatgcctttggactcaaactagaactaaatttcagcttttctgtgtctccagcttgccaattgcagatattgaaacttatcagcctccataatatgtgagccaatttcttgtaatctctctttctctctctctccctctctctctctctctcaatattgagagcagtatacacagctaagatagtcatggaatggacatgatgactctattactcaatgttatctagagaaacatatgatgagcaagaaaggataagaaattggctcacaccatccttatagaggctgagaagtctcaatatctgtagttggcaagctggagacacaggagagattaaatgtagttccagtttgagtccaaaggcatgagaaccaggagagctggtagagtaagattcagtccaaaagctggcaggctcaatacccaaaaaagacaatgtttctatttgaaacattgaaaaggaatcctctcttaatcaactttatttgtgctattcacctcttcaattgattggaaagggctacctacactagagagaacaatctgctttcctcactccatgaatttaaatattaatcttatctagaacatccttgcagatacacttaatatcatttgtcagcatatctgggtacccatagcctagtcaaatcaacacataaaattagctattataagttcatcccctgtcaacctggcagccatgtgtctcctaaaaccatacttaattgtcaattaaagaaaatagcaaggtcataattctgcctgatgtgatacaactatcctgtggcaaccaaaaatgcactaaccccttccctagaagaggaagcaaagtccttgagtggatgagggctgcctactttgaatatacatggatgtgtataaatacacatttttttctgttcctctagataaccttgactaatacaatcatcatgttcattccctgactatcttagctgaaacagagactaccagtcagtactcttattgcccccgatttgtttattgaatgtacttgctaaaatccaaaaaatacaaatttacttattgtctacatcaaatataatgcaatcactatgggagtaagtactttgtatctctttttacatcacagaatagattgcataacataaaagtgatgctcaacaattacttgttaacctagttttgattaaaacattctgtagagttcaaaaggttctatttttgcatatatgttccctttgtttttataaataaataaattatattaacttaaaaataatggatataatggctttgaaaattctgagactcaccagatggcaaatgatgctgaaatgaataaatagctttcaagcaaagatagaatccagggcactgccaggaaagtatggtccaaaattgtagccaaaaagataactgtaaaattttccatatgttgcaggaagatcaaaggttgtgctttggaatgccatttagttagacatacggtcctctaaaatataaagtatatgatatacagataactcaatcgaacaatggaacctgcaggaagctcacagcattgctctgcagcctcctcaacaaaagttcaagaaagagaagggcatgtttctgaaagtattactgagttaccctttgtgtatgagtgaatctcagtaagattcacagtaaacctacaaaaatttgaaggtaaattacatatgtaaaaatattgataatttaaactgaataagccagattcattttaaagtgggccacccaagtttctttaagcagatagcaggctgagtaaactactcagagttaaatatgttctaacttttatgaaaaagtaggctatttcaaaggataggactgagaccagacggtggaatcaagaaatagccattgattggtaggaataggattaaattcccctcaaaaaaaaagaaaaaattaacattttcccagctagatttcagaactctcattgactgctgacttctgtatgtctccctttttcctctattaagtccgagtgtctatgatgattattctatgcctgtctcatcattttatgatagatgtgtgaaagataggtaagttgtttctttagtttcaaaggtcttcaaatcaagacaaactgtactcaaggagttgtatttgcagctagacctgatttaaatgacaagattctagacttcaaactaatgctgtgatgagatgaagctttggtagacttaggatacaattagtgaggtgtgtgcattacttggagccagagagcagtctacagtaaccggcctctaagaaggaccccaatggacattacctccaggtattcatgcactggtatagttgcctcccgcagtgtaccagggttcatctatatgaccagtagaatatgccagtagtgatggtatgtcatttctaagatgatactatttggcactcaagggttagccttctgggaaacatagagtttgggattttaaatttagaaactgaagcaacttttattctggtagttacatgctctcattactgcttctctctatatatttctaataataattaatttaattaaatatcttcttcttctcaccatacaattttttcatattttactattggtaatgattttaactactacagatgtggtctgtatctatctgcctatttatctgtgtctctacaagtgcataaatgtgtgtgtggtgtgtggaggggagtgtatgtatatgtgtgcttataagttcatggatgaattacaaagctttcatatgtgcatttcagtttactcagaagttagcaaatttatttttggacattttaacctctgtattactatgaaaagatccacatttccattttcatgtaatctctttctttctccctctgtcacacacacacacacacacatacacacacacacacacaccccccacactccaaacaattcttcatttgtgtagatttgtgtattaccctcttcttggttttgtgtctctaaattatttacttaaatattaagttagttaatttaattgtgttccccctctataatttccatatacggtttacctttgaaccatataggtttgaactgcatgggttcacagatacatggattttcttctgcctctgccatccctgagacagcaagatcaatccctcctcttcttgtgcctcagcctactcaacatgaagatgatgaggatgaagacctttatgatgatccgtttccactcagtgaatagtgaagatcttgtaattctcttaataacattttctctcactttctttattgtgagaatgcagtgtataatacatataacatgcatgacatatgttaattgtttatgttattggaaaggcttctgatcaacagtaggctattattatattaccagcagttaaagtcaaaagtgatacagtgatttttgacttcatagaggtcagcaccctaaccactgtgttgttcaagggttaactgaaaacgcactggattgcatgagcataagataataatgagaccttaactactttccagctgaggtaggggaatttaaattctgcataatatctgctgtcaatagatttgcccagtaaagttttgtatcaaataagttctaagtcttatttcacatttttatctcagtttctaaatctgccattattacattggatttaggagcaaaatccattataaaaaacctgttctaacaagaagactgttttttggtagtctcttaaacttcatattgggtgaagattatgctccttgaggataagattcatactgtaacaattttctatatcctccacaatgttttgcagattcaataactatttaatgaattaagttaaatttacctatactcttacaagtcttactctcataaataaccttctaatccgcaattcctctaaaacatacaaaaaattgccaatataaaaaagcaagaaagaaggtgttaaccattttgtcattcaaaatatgactcattctttcttatacaactacctttgtcagcattcttgccattggactgtctagcctttgacactgttatatcatggcttgtcgttagagaaggtaaagtttggaaaaaagaagcagttacgtaaagcaatgttagaaaatccttgagtttcccttagaattttgtgtcttctacgtgttttctatttcacatagattaagtttgcagagttgtgtcataatttcatgagtgtatctgtcaaagagccctttgaaggcctatttaatccaactaagaccattttttcttgttttaataccattaatcttgttctctctttgataactgagggaaaagagaaagacattccatataatacatcagatgcctaagtgctttggatagtcataagccttttctcctatagcttcctaattagaaatgcctgctctgcggagttttcttaagttttccaacttgctccttccattttataatagtctattgaggaagactattatcaaataaaaatcagaatgatcactggacacctattttagccttgggatttatatcacaattccctaagacttcatatttccagaaaagaaattcaaactaaagctcacaattactattattatggtaatcctgataagatgtacattttaactaaaagaagttcccactattttttttctttctacttttcaataatccttgggaccttagtaggagtgtgcaatagtcttgtggtgtatttttagtttaaaagtctatctgattaccacttggtagatattgtccaaactcacttttgaatccaagtgtttttacccttatataatttttttaaaagagtatttgcttgtttctattatactataactattggagctactaggaggccttttaaatttcaacaacaaataggcagaatggagactaactgaagggttgatgggcttaaagaaaataaataacctaacaaaggctaatggcaaaaccaacattagaaaccaagtcactttacttgggattagtggataccaaaatgtgctttctcggaagcagcactttacaaggaaacatgaaaatccacctttgttgtccttcagctaaagggaataaaatcgtgtactttctgtaattttaaccttgttataacagatgctacagaaactcaagtggaactctgactgccttgagagctgaataaaatgcatcctaccatccattgctgctgcatcaaggtattaaaaagagagacagaaggaagaggcgagagaggcacaagttcaacagtgtgagggacttggacacaatgggagggagaaagaaataaatgtctaaatgtcatggaaagaacagacaatgaaggcatatgtaagaggcctgctaaagctatgggacctcagaagcctatttgtaagaactacaatttagaataaggaacttgcaatacaatgcctgaccttcatttccttacgtgcctcaatcttgtcaaaacctttgattgatttttgtatgaacatgaattactgctacaatactcagttgaactacatgaatttctcaaagcagtaatacagtgctatagcgtagcttaacattgtttaagtaatatggtttgcttatatttaagtcatttctaagggacccatgcaaacacagtcaggagatctatttctgatgtatttccaaggctaaaaacaaaaaatgctgttaatgcataaacagtcaaaaagctacgcattgtggttttacagggacttctatttctaaagatgatggttgcatgagggcctctgcctttataagggaaatgtgtagattttaactagctctgtattataatgtttgtgttttgaaaaagaaaagcatgtttctgcactaaaaaataaattcctaatcaaacctttaaagttaacatttagaacagggacagaaatttctattgtttcctaagtgttttgttgctgttgctgtttagatttaaatcattttttagaagttttactgaggcataattgatataaaaaattgtacacctttaatatattcacttggatgagtttggacatgtgtgcatacaccaataccatcatcacaaccaaggtactgaacatacttattcacctccaaaaattttcttttgttcttttttaatggtggtagtatatttttaagaattcagcctttgagcagggtatgaaggaccttcaacaacaaatgcaaaagtaaatgagctaagttcatataaagggttagctctcagtgagatattcaagttatgatcatatcctcaagaggcttgtaaactgactgtgggtttccagtttggttattcacagataggccttcatttgctcattcacctattcattcatatagccactcattcattctcaagaagaggtatttgtccatatctcaccatgtggatgagcagatggtcagttctcacttcttttgccattaagtgtgctcaccgttgagctccaggatggtattttctctcactttgcgtcattaccaaagtggctatcaagattccctcccctaccttctttttcttttttcaatgtttaagagctggagttaatttcttgactcctttggtaacacatgccgatatataccactcaaggcctgttggattaaactgttaaatttgtcatctagctaatgttttctcagaaccagacaaattaaacagagtcaattgttgaaattatttcaaaagataaacaatcatagaatggaaataaactacagaaagtagggaacaggagtaactaagtctcctagaaaacatttgcagcagatgttaagtatccagtctcgttgttataaatgaatttcaaagaatctcatgaggagcagctttacaaaattttactgcactaacaaatggcagccaacatctgtagtaaacacaaaatactgtaccatcctttgtatctccttaaattaagccaatttctgcttacacagaaaatctgtctgtggaaaacactgcttagaatttgaaagcacattaatctggaagccacaacagaagtgtgcttcagaaaacttcttaatgtttttcttgtgagttattctctttacgcttttcacattacaatattaccaagttatcataatgtattttctgcactcccagagcaagataagactctagttgttgctgggaactatacattgtctaaatatgggttcacattctctcacagtgattctggaatcatacacacaaatgagatcactgctgtcacatcactggaattaagacaacctctctactcactggccatgtaaatatagatacagtactcaaatcctctgaggcttagctaattattggttgatttggtctacacttaccacattaactatttgaaaagattcattgatataacatgtactaagaacagttcctgactcataatcattattaaggcaatatttaccaatatgtgacattaaaatagatactactattagataataattcatactatacattcaatatttaagcaacagaattataattttgtgaagtaaattttgtactcaaatagaaaatctaattctataattattttctgcaatattgggtcatagaaccaacaaagaatatgtgactagcttagacgtatgtatttacttatgtgattagtaataaaattcttcactcattcctaggtttgaatcccagatgctctgtgtagcagctgtatagtcttagacgagttgcttaatctgtctgtacctcgatttcctcatttgtactccaattttcttatgtggtaaatataaaattacttaactcagagctatgaggtcagttttatttgagagaatccagaaaaaaaaaaaacttaacacacatttcctaccattcggcatgcataatacgtactcaaggaaattttagatctctgtacatgattaatatattaaatcctcaaaccgactataaggtctgaaaatgcatgtctttatgtcactgtacctctcattgcacttggcacagtgttgtgaatatatttgtcatttgtatgttctttctaccatacaattctgccactccaattagcatattgtgttggaaaacaattgagtgcttgccttatgttttactaaatttatatggaactacgttgacacttccttgcccttaagatgctgggactcactggttgctttctagttctcaggagtctctatgtgactctgtcctttacacttgccctgcaacatcaccctcagccctagacaaagccaacatcatttttaaaaacctgcaaatatgtctgcaattcactgtatgaatattctcattctatcaaaaccctgacctcactaactcaatggagcaatataggatgataaagtagtttatatgaaagtcatagaaagtttgctttgtttattcacccaaaggtatgtttttaaaggatgaggcttttatctgaaacaaataaaattataatttgaaatttcaaataatgtgactaatagattatgaattcatttccaaatatagaaataattaaaatacttgggggtatagaaaaagtgagtgctgtatctattcttttattatattaattttaccctagctgccagaatttagtacttttaacatcaactgagagatttaaggctattgtaattttcctattttgattttcctcttctatttataactcaaagtaatttgataatatacactgtgatgtgtccccatgtatcaaacatttaaaaaatatatttggaaccaaagcaaagatacatattttttttaatttaattttttttttttttgagatgtcacccaggctggagcgcagtggtgcaatctctgctcactgcaagctccccctcctgggctcacgccattctcctgcctcagcctcccaagtagctgggactacaggcgcacgccgccatgcctggctaattttttgtatttttggtagagacggggtttcaccgtgttagccaggatggtttcaatctcctgaccttgtgatccgcccgcctcggcctcccaaagtgctgggattacaggcgtgagccaccgcgcctggcgcaaagatatgttttactaataccacagaggtataatctgctgctatttcttgatcagaagtaaacaagtgtcttcacagcagttgatctaattttcttccccattcattcaatggtattttttgattattatagaatatattgaattagataatgataagtcctttttctttttttttcagaaatggcttctctctgttactgaggctggattgcagtggcattatctcgactcactgcagcctctgcctcctgggctcaagaaatccttcgacctcagcctcccgagtagctgggactacaggtgagcaccaccatgtccacctatataatttttgtatttttttttttttttttttgtagagacagggtttcactgtgttgcctaggttggtctcaatctcctgggttcacaccatcctcctccctcatcatcccaaaattctgggattacaggtgtaagccactgcacccagctgagaaggctttttattataggttgttcttattgttttatttagttggttttcaaggtaagtttgacatataaggtggtataatgtttaaaggtcaagttatagagatagctagattgaagttcaaatccagagccaagttacttagactctctaaggacttgttttttcccttataaaattaaaataaagtggatagccacttcataggtttgtaataagaattaatatgatcatgatgtcacagagttgcaaagagatactgaaacttggctctgccaaaaaatattagctattgccattatgattgttctccttaatacctaaggcatttgctgacaatcaggttactcatcatgtccttccaggaaaaaaactttaagaatgttgaaaacttaggaactacttttaaaatttaattttcagacctgacataacacagctgaggaagagaggtggtagctgattggggatagatgtagagatcattaatggtataagagtgtgagaatgtgaagcaggataggatatgatattactcatacagatcacaaatacatgtcaaaattatatttatcattcatttaagtaaaattcaacattgttttcttcaaagaagaaattgcgcatttcactctacctatttaactctggaaaattttacaaactgagcatgccattttttagtatgaattcctttatttcagctgccctgctaactttgcatgatgagcagaaaaaaatgaaacagaatggttagttctggaatatgaaaaagtatccaagaagaggagtagtcttgagaagtagggaacaggatgaagtcactaggggacagaagggtaggagggagtgggaccagacaaacactgagctctgcatgcacacgtaacagtctaaaatagtcatccagcacgcagactctaggtcaagataaccaagatgaattgcaacttctccacaagcaacatgactttgggtaaggtatttaacttttctgagtcttagtttcttcaactgataaataaaaatgatggtcatatctacttcataaaattgtgataactgattaatacatgtaatgaatagtgtttggcatttagcttaataataagacatttcattaaaatattagctacttttgttagctagcaactctcaattttgcctaaagctgaccccatatctagggttaggttttgaaagaagttcatcaccatcagaactaggtctggaaattataaaggaaagcttaaaaaaaaaaccagaaatatgtgcaacacctatttacaaagaatccactgggaaacccccattgagcccaggtagatggcacatgtcccctttgggcatgtaactcagttccctgagggtcagtatattgtctttgtttcaaaggtcccaaggcaaactttttaataattgtgatcccactcaatagtcatgttcacttactttgtgggtacatttgtggcatattttaaaatgtgaagttgagtgcatttcacttaaaaaccaaaggcatgtaatgacaacatgctatagaggaaaaattattgatttgtgtaaataggcagatcttgtttgtattctagctccatcacttactaattttgtgatatgggcaatttatatcctatctgagcctgtgtttcctctacaatatgagataatttctactttgaagtactgttatgagggttaaatataaattactttctggtttatgatgttggtatatactatttccatgcatgatagttatttttatgaataagattttaacagtaagccatagaaaaatacaatgtaagactgattcttagaatctatcaaaacaggttgtaaaaatgacttaaacatctagcatggcagtgactaacattttgaaaagcttaatttttccattgagaactgtagcccaacacagtgtctgtgcctcagtgttcctcttatcaggaaggataatatctgtgatgcatggactaactctaatgaaaatttttattcttaagacacaagatatttcccagcacagtacataaggtctttgtgctcatgtcagcattggagataaatttctgggaaagaagtagagaaaccgctcatttctatagacatcaaaacaccaaagtaaaagtgaaaataaaggtacgctgcagacttttttttaaatgcctaaactaaaaagtatacctatcaggaaacatccaactcacaaattgctttaaatatgtttttaaaacagtgtgcttgttttataaccacagattcatgctatttatctgatattcccaggtggttgctttgtggggctcagtgccatccttggagcaataaaaagcatttcttctacaccagtaaaaaactggctacttctcacataaaccttggagggcttccctcagtgggcttagtgatcagcaaatcatgtcaaataacccttttggttatttttgacataatagtgttcctagcaggcagtactcaagaattcccagattcttagctttaaattcaatatactctcttgtattaaaagtcaagctatttatccacagtagttcttaggtccacgtttcattttacacatatatgtggatgtaacagctttttccttagaactttttaaaaaaatggaattcagtaaaagtcctatatttgtattttctatgtgccaagaacagataaccatcattaatgtgagccaaatttgaattgaggagctgaaattaggaggaattgaaaaacacctgaaataaatcttcaagtaatgaaggggaaagtttactttagaattagtgtatcaaaaatgagaaaattggctgggtgcagtggctcacgcctgtaatcccagctctttgggaggctgaggcatgtagatcacctgaggtcaggagtttgagacttgcctggccaacatggtgaaaccctgtctctactaaaaatacaaaaattagccgggcatgatggcacatgcctgtggtcccagctacccgggaggctgaggcaggagaattgcttgaaccacggaggcagaggttgcagtgagccgagatcacgccactgcactccaacctgggtgacagagtgagactccttaaaaataaataaataaataataaataaacaaataatttaaaaaagtcattgctttatttttaaaaaagtaatagtttcaaaatgtatacatgtaaaatctaactgggaatactttgtacctacttgtagcccaagattaagtttattctcaattactaggaggtttgcacaatagagtacatatttaatctgtatgactaaaagcctcattgtcaatgtgactgtgtcatcattatcacatttgtgaatctcctgattataactttcacagatggtctatctacagggttctgggataagaaacttgctgtctgtctacagaggaagctgttttcacttccagatagttctgaatatttgaaagtacttgctgattcagagtcaaattatgtcttgctgtaacatccacaatttctgaacttacatttgagataaaccaagattagactaaaccatgccttcaagtgacagactctcaaaaatgtgatgtattttttttcaaaaaaaactgcacgtccaggatactctacctggagaaaaacgtagctctcattaaccttgtccagacattaaacttataagagaaaatcattattttccttgtagccaaattattccgctaaattgtttttaggcaggattaataaacctttactgtaaagggaaagaggctaagatcttaggttttgtgggccatataatctctatacaactattcaactctgctgttgcagtgagaaagcatttatagacgatacacaaatgaatgagtgtgtccatgctgcaataaaactttatttacaaaaccagtctattggctggatatggcttgcaggccatactttgccaacccttggtttacagcctggctagctaaacactgcttgttgtagtaaaatcttgctttttaaaacatatgtctctcatcctagcattgtcattacatgtgtgtggtttattgttgaatatgtaatatttaaggatctttcctatttagttttattgactaaaagctgtttcataattataatacacagacatctatataggtttttattttatcattcaacctattagctaatccttagagttgtttcaattttcatgtgtttgacagatgaacatgtctaaaacactgatgaaaatgttaccagaatataaacaaaaatgaatttttccggttaaaaccattttacttgttagtaatatgtaactattaaccattaaataatttaccaaattattccattacgtaatccatattgctccttcttgtccacaagaatatagtaaggtacattatcaaatacatacctctgactttagtgggcatttaatgtattattagaggatcccaatatctgtctttcttaagaaaattaaactcatccctagtgattatacactttcttcatctaacactataatattaataacatttgaaaaaataatgtctaataattaacactagatttagagtatttttagacaattttctaaaattatctgaaaaatttgaccagaatcattgtaaaattcacatctgagcttatgaaagcccactttattccactctaaaagaacaaaattttgtacttttaattttatcttttaaaatgttttaacataaaggtagtgggagacgttactaaaggaagcttaggtagtaacgtatttgtcgtctcagttaacacaaagaccatagatggggcagatctgcaggatgcaaaaactttcctttttctcacctcatagtagtcatatggctactgcaattctctggtttcatgtgcttacaaaatgtcctttagttaaaaataaaaagaaagagaaagagaaagacaaagaaagaaaaagaaagagaaagaagaagaaaagagaaaaaataatttcttcatgtgtctatttaaattaacaaagacgtgaattgtcccagacctccctgtgatgattaatttcatgtgtcagttttactgggctaagggttgcccacatggctgataaaacattatttctgagtatgtctgtgtttccagagaaattagcatttgaataggtagactgagtgaagaggatcatcctcaccaatatctatgggcatccttcaatctcttcagagcccaaataaaacaaaaaggcagaggaagggtgaatttaatctgtcttcttgagctgggacatccatcttctcttatcctccaatattggaacacctggtctatgttggtaggagtgtaaattagttcatcataaccttgttggcactagggaccagtttcatggaagacagttttttcatggaccgtggtgtagggaagatggttttgggatgattcaagcacactacatttatttatttatttatattattattatttttgagatgaaatctcactcttgtcacccaggctggagtgcagtggcgcaatctaggctcactgcaatctccacctcccaggttcaagcaattctcctgcctcagcctcccaagtaactgggattacaggcacctgccaccacacctggctaagttttgtattttcagtagagatggggtttcaccacgttggctaggccggtctcaaactcctgacctcaggtgatccacctgccttggtcttccaaagtgctgggattacaagtgtgagcaaccatgcccggcacaggcacattacatttattgtgcactttatttctattattattacattgtaatatataataattatacacctcaccataatgtagaatcagtgggaaccctgagcttgtttttctgcaactagaggtcccatctgggaatgatgggagacagtgacagatgcacacactgcagggggattgcattagatcatcagacatcagattctcataaggagcgtgcagcctagacccttcacatgttcagttcacattaagattggtgctcctatgagaatctaataccaccattgatctgacagcaggcaaagctcaggcagtaatgcaagtgatggggaatagctgtaaattcagatcaagcttcgcttgcttactcactgctcctactgctgtgtggcccagttcctcaccaggccatggacctagtccatggcccacagggttggggaccccgatctaatgtgacaactctggaaatcagattctataccccctatttgttgttgctgttgttgctgctgttattgttgttcagtgtctaatgagctttctgaaataattttgtagtctgggactactcttcaacactcagccaggcagtttacatctctgccttagccttcacttcctgcttgcccagagcctcaaggccagtcagaggtgagagctttgagccttcccaggtctttactgaacatgtacgcaggcctacacttgggagtagcctcatagatttctaggaatcattctgttggaattttcaaagcccttatggacatctcattctcctgttttacttttaaagctttttagttagcctattgtctgcccaaaatgttatctacaacctcatacaggcaccaacttgaataacggcctttaaatgtttttgacaaatgccattaaggaaaaggctttttcgttaagtgagctcttaggacagaaaaagacatcctggcagtgggatgtttctgaaaaccaccagccaagtcaaatgacagttctctgggaatgaggctttgaaggaaatccagccccattctgtctttccagtggctgccaggctattggtcttcactgtaattatgggctgttaattttcaaggctgcagtggagccagcgaggagaggatgagaatagaatagggcaagttaaaaataccatactgcttgctgttcttaatgagatttttcattttatttatttgtgtgtgtgtatatatgtacacacatacacacacacacacacacacacacacacacacagtgaatggaaaataaatcttggggccccaaaatcactaagctaaagggaaaagtcaagctggaaaagggttagggcaaacctgcctccaattctattcaaagtcatccctccattcactgagataaatgcatatcggattgcctcctttggaaaggctaatcagaaactcagaagaatgccacttgtctctcacctacctgtgacctggcagccttctcactgcttgtgctgtcccacctttcttggcaaaaccaatgtatatcttccatatattgattgatgtctcatgtctccctaaaatgtataaaaccaagctgtgccctgactaccttgggcacgtgtcatcaggacctcctgaggctgtgtcacaggtgtgcctcctcaaccttggcaaaataaacttcctaaattaactgagacccttctcagatattcaaggctcacattttggcaaccatgaagggattctgggtggaggctcccctgacctttgacaaatctcctatcagtgctcggtaccagcttgaactatctttatggctcaaaccaatagaacaatttgccgagacaggcctggaagcaccccctccagagaatcactgatctttcaaaacttggtcaagatctaaagtttattttgcagtacaactccttttttttggagttttactatcttccaacgcaagaaaggcaagtttttcctgctttgatgacgatgaaatgcaggtaactcctttatggagtttgagcttgcttccaacggggaagacaaatgtgagtttcttccttcttctagtaagggaggagaccacccctcatatcgtcttatgcccaatttttgcctccaaagaaagaagtaaaaactaaaaggcagaaatgaaatccacaggcagacagcctggcgccgcaccctgggcttggtagttaaagatcgacccctgacctaatcggttatgttatctatagattacaggcattgtatagaaatgcactgtgaaaatccctatcctgttttgttccaatctaattactggtgcatgcagcccccagtcacataccccctgcttgctcaatcaatcatgaccctctcacacgcacctcttagagttgtgagcccttaaaagggacaagaattgctcacttggggagctcggctcttgagacaggagtcttgccgatgcccccggccaaataaaccccttccttctttaattcggtgtctgaggagttttgtctgcagctcgtcctgctacactaggatggtaaagagcagtcttcagcctgagacccatcccttacctaaggatgggtaactaaactgggggttgtcttggctaaagttaagattaacaaccagctggttgtaatttctctttaccattagagcactcagtagttggataagttgtgccatctttgttttgcttaattgtttttgttgttgttgtttgtttgtttctgtttttgttgttgtttcagtctttttgccattgggattgatcaactctatccgacttgatcaaatccaaaggaaacttccaaattatggggaacaagacctctgaagtggctaaatttccacactgtggtgggggagaaaaacagccaaaaaaggggaaaaaaaaaaacagggaagattttttactttgactacttaaggggctttatttacataacaaggccacctttttgctagccaggccaaactgaaagagcaatggctgtcactccatactgcagttccatagctaagggctctggcttctttttttccaccacgacagcttgggtgtggttcctaaatcaagccatttttggtttgatacttggtacttctgaaatagcagcaatttgttctagctgaattatggtaatgagattttaaaagatttttttaaaggagctcaatgattaaaagtcagcttaactaaaagctaacatccaagatgtgtgtgtgtatgtgtttgtgcatgtgtgtgtgtgtgtgtgtgtatgtgtgtgtgtttgtattgaaaaggccttcacatatttttttttttctcctaggaccttgtctctctttttttttttttagttaaagatttttttttctcagttgactgagttctgttttttgttttgttttgttttgttttatttacttctgctgcctctcctttctcttgcaccctctgctgcttgagggacctaaactattatagtttataatagcctggctttccttcaagaaagcagagaaggcaccagactcctttttggggagaaacctgtttttccttatgaaaccccaagagtgtaagcagataagttcatctcagctcttaaattgcctgcttttgtattgtgttacctgacttattgactaaaagagttgttgcaccaaagcctcctctggtttttaaggaagagtgtagtttacacattggaagtgtcttcgtttaaaaaaaaattttaagtgcactgaaaaagcatcacatggtctagcctcataataattctcccttttgggagattcaggattcagtgtgggctctgcccagagctcagagatctagtcaaaagacaggtatttcctacataaataaaattggtctcttcatataatcctatgacagatttctttttttttttttttctgagacagagttttcgctcttgttgcccaggctggagtgcagtggcgcagtttcggctcactgcaacctccacctcccgggttcaagtgattcttctgccttagtctcctgagtagctgggactacaggcgcccaccaccacacctggctaatttttgtatttttagtagagacggggtttcaccatgttgggcaggatggtcttgatctcctgaccccaagatccacctgcctcggcctcccaaagtgctgggattacaggcatgagccaccgtgcccggctatcctatgatagatatctgtaactttatgtttgatttggcatccctcttttgttttgttttgttttgtttgagacggaggctctctctgtcacccagcctggagtgcagtgacacaatctcggctcactgaaacctctgcctcccaggttcaagcgattctcccacctcagcctcccaagtagctggaattacaggcatatgccaccacacctggctaatttttgtatttttagtagaaacgggttttcaccatgttggccagggtggtctcgaactcctgacctcagatgatctgcccgcctcgacctcctaaagtgctgggattacaggtctgagccactgcccctggtgtagtacatggttttactgcatgtgactagtttacatgcaactagccatgcaagttcagtaacccaaggcggtctataccctgttcaacaagaaccatctactaatgacacttctggaagtctgggcaatgtcaacttgctgtaaaagttcccaaatgctctcaattatcatatgataacaaaggtctcaaatcagtaaattttgagtggccctttactaggaataatcttgaataagctagtactgccctccacaaccacaattaaaaatatatcggtattggttttctcttcagttcaagaatcatgtaaatatgtaatgtagaaaatgaggatttcccatattcccacagaatcacaaagatgatcactggtaatatgcgtgctacatatatgataccaggtttattctactctttttttttttttttttttttttgagacagagtctcactctgtcgctcaggctaaagtccagtgctacgatctcagctcactgcatcctctgcctcctaggttcaagcaactctcccacctcagcctcccaagtggccggaattacaggcacctgccaccatgcccacccagctaatttttttatatttttagtagagacgaggtttcactaagtagaccaagttggtcttgaactcctgacctctggtgatccacccacctcggcctcccaaaatgctgggattacaagcatgagccaccatgcctggccatttttttgtacttttatacaattatatgcttgctttataaaaatgaacttattctacatatatatgttattacattattaggacatgttcccaaatgacatattacattttcatcattcttttttaaaatattttttcgtgagacagtgtcttgctctgttgcccaggctggagtgcagtggcctaatcacaggtcactgcagcctgaaactcctgggttcaagggatcctcctctctcggcctcctgagtagcccagctaagtttaaaaaaaatttttttttggcctggcatggtggctcacgcccataatctcagcactttggaaggccaaggcgggcagatcacttggggtcaggagtttgagaccatcctggccaacatggtgaaacaccgtctctactaaaaatacaaaaattagctgggcgtggtggcaggtgcctgtaatcccagttacttgagaggctgaggcaggagaatcgtttgagcccaggaggcggagggtgcagtgagtcgagatcatgccactgcactctagcctgggtgacagagcaagaccctgtctcaaaaataaataaataaataattaaatatatatatatatatatatgtatatttggagagacaggtctcactatgttgcccaagctggttttgaactcctggactcaagcaatcttcccatctgggttcccaaagtgttgggattacaggtgtgagccaccatgcccagacattttcatcatcctttttttttgagacggagttttgctcttgttgcccaggctggagtgcaatgtcacgatcccggctcactgcaacatccacctcccaggttcaagtgactctcctgcctcagcctcctgagtagctgggattacaggcatgagccatcacgcccagctaattttgtatttttagaggacacagggtttctccactgtttttactagaccttgatcacatcaaaaagattgtgtctcttccatttattgtgcagcttgtacacaattgacacaatgaggagctcagcaaaggacgcagagtgacagcatcctcccttcagtggaatggccatgtctagacacctcttaatcactcccgagaagtagggatgggttcggtgtatgagaataagaaacggagcctccagggttgagacaatttgcccaaaacacacctcttgtgggaagtacagttgcgatcccccaggtctcttgggcttgcaggttcctgctctcccgtgggcccccaggagatgttggctgccaagaggaggaggaatcctcctgggcagaggttaacttttgccactccaggatttgcccaccctggggtccctgccaggaatgttcccccagcaccaccctccccatgccgcctcctaactggctgtgtccttcccaccattcagcaaacacatcctacgtccaggaccagccccttcatctcaggaaggctgccatgggactcccagaacccccatggctcctggagccctgagggaatcacatcttgggtggggagtgatttgttttctcatccagtgcaaccttggaggtaacagtcaagaatgtcctgtgatgcgaagcacttattgtcctgacctctggtccagtgcccttcgctctaagcacatagcatccccaggctgttcctggaggcgtgggctggggtttgtagggactagctggaccagctgggccaggggaggcagccatgcccggggcacatagccactgtccagagctgcccccagagctgggagccatcttgcacatggtgctgtgagatgccctccagagaggaagatggaagctgtctccgtgccccgggactgatgaagggcccattccaggcctttgggcacccgggctcgctacccttctgggagccctgtcctgtgggccaggacaaaggtgccctcactggtggcattctcagaagctcagccgctccccacacatgcacataggggcgtgcccacaccaagccacgtgtgggtgtctggggacaatgagtcttgggggagggggtgggtcccttccagaagggtctggccaaagtccagttatgaaggtgagctgagatgggctccctcaaaggagccatagtgtggggagccccgggcagagcccagagagaaatgccagccccgagaccgagacacgctccaaggagtgctgccaagagcagtagacacagccgctgaggcccacggggcacagtgaggctgtgggagagggtggcccctctgtggccatttccctgcctgtgctcacatcccctcctcaggcctgtctcaccagctcttgcagcccatgacccacattctgtctgactctccttcctctcctggctacagggatccccagtgcccctcaccattccttctggtctctcctctgcctcccggaactgttccccaggaccctctcctgggccagcccttcctgcccctccacatcagtggttccgaaccccggatgcctttgggatcagctgggtacactttaaatccttccagcccagagccctcaggcccaagtcacccccgccagctcctgtgggaccccttggatcagccaaccattttatcatcatccatcatgtcccctgtcaccaagggcctctggcatgttctgttgtccccatgcccaccctggcacccctcacccaccaacctgtgcccacgtcctgccttgagcctgtttcccctcctgagtggtatttcctcactccaggtgggcactggggcagctggcagacatggctgtgagcttctgtcccatccagagggaccctcccttccagattacccagtcaagcttgaccccatggtgtcaccgagacggaccaaaagagggtattgaagccacgcagtcccccgagccccactgagctgcaccagctttggagccggagagagcctgggagactgagcactgagtgctaggtcccttcttcccactcttgagggagaaatcagtgtaaccttcccatcctcccactcttgagggccctggggggacacagggcacaaggagggtggcagaagaggtgtgtgcctaggtgcttggcacctagccggggttcatttctgtcctctcaacttggcctcccaaagtgctgggattacaggcatgagatactgtacctggtcttattttttcttttcttaagatacagggtctcaccatctggcccaggctggactcaaactgctgagctcaagtaattcccccacctcagcctccgaagtagctaggactaaaggcatgaaaccaccatgcttggcttgtccaatttcattctacacactttctcggtatttaaacagctgctgttgctcttcattctgtagctctacatcagattcatgctctagtcctgtatatccaaatgatgactagaggctgccggctctgctctttcaaaggcacaatgagcgtagtccatctacaaaactctcccttttccaatccagctttccctcctgcatcacctatctctctacatctggaaccatcggcagctgccttcataaggcacctcggtctggcattcggaaaaccaccctgtcttgccagagcctcttggtcttgggtagcaaaagctgtatgcaatctaaatcaagctttcaatcatgagaaatcacattccttcttttccctttgtaatatactcatgtgttttttttttcctttctcaataagcaaattgtaccaccatcttattctgagatgctcctttttaaaagctgtagatcacattaatggaagtgtttactgctgggaatattttccacgtgcaatgatctgtaaccctctttttcttttttttttgagaccgagtctcgctctgttgcccaggccggagtgcagtgacacaatctctgctcactgcaagctttgcctcctgagttcatgccattctcctgcctcagcctcccaagtagctgggactacaggtgcccgccaccacgcccagctaattttttttttttgagatggagtctcgcttggtcgcccaggctggagtgcagtggtgcaatctcagctcattgcaagctccgcctcctgggttcacgccattctcctgcctcagcctcctgagtagctgggactacaggtgcccgccaccacacctggctaattttttttttttttttttttttgtatttttagcagagatggggtttcaccatgttagccaggatggtcttgatctcctgacctcgtgatccgcctgcctcggcctcccaaagtgctgggattacaggtgtgagccaccacgcccggccatgcccagctaattttttgtattttttagtagagatggggtttcatgatgttagccaggatggtctcgatctcctgacctggtgatcagtccgcctaggcctcccaaagtgctaggattacaggtgtgagccactgcgcccagcggaactgtaactctcttatctcaactagctgacattattacttcacatcctgttcaatttataaattaagagaggtgccatgggctgggcacggtttgttcactgttgtttgaatgacaaactcatctgcctttttaagaggccagtctttgatgaactttaaactttgtaaaactaatgcattgtgcctgtgtataaaccagtggttctccaaatgtgctgtgtggacctctcgggatcccgaagaccccttccagaaggcctaagaggtcataactgttctttttttttttttttgagaccaagttttactcttgttgcccaggctggagtgcaatggtgtgatctcggctcatggcaaccttcgcctcccaggttcaagtgattctcctaccccagcctcccaagtagcagggattacaggcacctgccaccactcctcgctaagttttgtatttttagtagagatgtggtttcaccatgttggccaggctggtcttgaactcctaacctcaggtgatccgcttgcctcggcctcccaaagtgctgggattacaggcctgagccactgtgcctggccaacactgttctgaatcatactaattaaacctgagaaagctgatgaaaaattttaaaaatttgtgaaagtaatacaaagtcattgcctgctttttcattgacacttgccatgattatataaaagcaaaagtgggtacaatggctggtttctcagcataaatcaaggcagtggtaccaattacattagtagtcattctattcttcactgtcccctacaggtaaaaaacatagcctgaatttcttaagaatgtctttgatgaagcagtaaaaattaatgttgttaaatcttgacatgtctctaatattctgaataagtggaaagttaaccagaagcgctttttttgtttgtttttaaagaatccgtgatttaactgtgaactgaaaaatcacttttttcacagaacatcatttttatttaaaagtacaactgggccagcgcagtggctcacgcctgtaaaatcccagcactttgagaggccaaagcaggcagatggcttgagctccttcaggagttcgagaccagcctaggcaacataacgaaaccctgtcactgtcaaacatataagaaaattagcctggcgtggtgccacacatctgtggtcccagctacaaaggagcctgaggtgagaggattgcttgagctgagatcatgccaatgcactccagccaagtgacagagtgaaactcggtctaaaaaaccagttcaactatcattctcaaaaataaatgaagtgagaggttgtcacttcaagggaaatacgtatttgttcccaatgataaaatttaagctttcctgtggactttgacaaacttgttccttctactgtaggcttggcagcttttcaatacttaaaggtgtgttaaagtaagattggtggttaaactgaaagtgatttttgacacaataaaacataaaccaatatattccaagtaactaatgcatgatattataaatgcaagtagtgagcaaaagatccatttactgtgcaagaaagatcaatgagtactgatggaataaatttattaatatgtaaaatgccaccgtaactaatttaagaaaccaccacttgtgaagttttgatttagtgttaacaaatacccacaactgtctgaaaactttaaaaatacaccttctaccaactacatatttgcatgaggttaggtcatcttattgcttctttttttctttttttgagacagagtctctctctgtcacccaggctggggtgcaatggcgagatctcggctcactgcaacctccacctcccaggctcaagcgattctcctgcctcagcctcccaagtaactgggactacaggcatgcaccaccacgcccagccattttttgtactttcagtagaggcgggttttaccatgttggtcgggctggtctcaaactcctgacctcaagtgatccacccacctcggcctcccaaaatgctgggattacaggtgtgaaccactgcgccccaccagcttattgcttttttgtttgtttgtttagacagagtcttgctctgtcacccaggctgcagtgcaatggcaccatctcagctctctgcaacctccgcctcccaagttcaagcggttctcctgcctcagcctccagaataggtgggactacaggtgcgtgccatcatgcccagccaagtttttgtaattttagtagagacggggcttcgctgtgttagccaggatggtctcgatctcctgaccttgtgatccgcccacctcagcctcccaaagtgctgggattacaggcgtgagccaccgtgcccaacctcttattgctgctttaaagcaaattgcaaagaaagctctagagaatccatttgtctcctattaagctcaacatgagagactttaaataatataaatacatgacgcactttttactcaactttttgttgtagaaaagttatttttcaatgaaaaaattctgttaacaatactgttctcaaggaatattttctgttgttataacctgggtcatgggttactactgatatctagttggtagaggccatgaatactgctaaactctctgcaatgcacaagacagtcctcacaacaaagcattatctagcccataatatcaacagtggtaaggctgtgaaatctaaactaaaaatagattttgaaaaaatttcaattgtataattctaccacactaaatatcaatataatcaatataaacacatactctttgagattctcaatcatttaagaattatgagactcttaaggaacaaagaaaatacaaataatttgcttcaatattttagtaggcacaatacagcttatgatgtctagagctgtgacctaacactgagcttgatatcttgcaaagtaattagctagaataacaagacaggtttctaaaaagctcacctttgtgtgatatgatgaggtatctccaaggtcacactgtggaaggaaaaaaaattcacaacaatagatgttaacatttgttaggcctgaagacattttttaaaaggggggcagaggaaactctcctagtggccctgaaattcaaatcttctagttcagaacagtaccataagggcactttgttttcatttctttgttttttacaaaaatatgagaaccaaaatgcaaggaaatatgccgttagaagacgcgtttctgttggtgattacaatatataaataataacagatttccttgttatatgcttttctacccacgaaacctttcgtcccatgcgatttattttatgtatttatttattttttgacccagagtctgtctctcttgctcagactggattgcagtggtgccatcttgactcctcacaacctccaccacccaggttcaagcgattctcatgcctcagcctcccaagaagctgggactacaagtttgtgccactatgcccagataatttttttttggaggggggcagtgggtggagtttcgctcttgttgcccaggctggagtgcaatggtgtgatctcggctcaccacaacctctgcctcccaggttcaagagattctcctgcctcagcctcccaagtggctgggattacaggcatgtgccaccacacccagctaattttgtagagtgaggctcaaaacaactgagggaaggcaaatctcaattctactaataggtctacacaatattagcactttttaaaaagcctgtaacattagcaggtaagatggatatgtctatggtgcttcaagtagttttcatctctgaaataattttaaaatcacagaatttaaagttacatgctggaaaggaccaatgaccttatgtgacatttaattcaacactcattttacagatcagggaaacagaccttaaaactgacttgcccaaggtcccaccaaataggagcagtttctcatcctaaactcaaattaagcagtggctctcaaactttgctgcacattaaaatcacctgagaagctttaatatctgcctcatcttccacgagacattttaatttaattagtattgggtatggctttgggcatcaaggttcttagtaaacgtttcccaggtgatttcaatcagcagcaaagtttggaatgattgagttggggtgaaaatcagaatcttctgggatgcttttcttcacagaaagatgcctcacatccatcccgattttcctaaaaggcttctcagtgcctagagatagagggaaagtggagatgggaagatacatgtgtttgcagacttgtattttgaaaaaaaccttgcataagtgatctcagcgagttccacctatcccactgacaacagtgcactactgattcatgataaaacatttttcaaaatatcttcttgaagccaatttgccctattaatttgttcaataactttatttcgccaatagtgaatacaccaaatgatcatttctcaaacttgctggtggcaaattaaaacttactatactctcaaaagtagacttctaaaaagtagaataatgaggaaaaaagcacgaaatttgtttcagcaaaattaatcttcaaagctgcttttgaattatatgctaacatatcaaaatctttggaactcagaagaagccagggactctagtcaaagtaatttttgtgtatgtgtgctcagagatttaagagacttagctgactacagacatttagtgattactcaataggtcccaaagctcaggacttgagacagagtttgagtccagtttttgttcgaaacacaatttcctctcaactattgttaaaagggagggaggaaagtgacattattatgagtgtaaactttccacttttaattgaagtaaaagttattgacaattgaattagttaaaaaggctagtgcatttgaaacaaaattgtttataagctagttatgtgtacagaatgaaaagttaaattaaagataaagacattaatattctaaattagcactttccaaactgtgttctaaaaatcaagactaataacccaaggagatgagaataatgtacactggacagcccctgtggagctggtggtggtgttggttgttgttccttttaaaataaacttcatctcagggtgctctcaaagcacatctttgtggcccatgaggtgctcatgcacaatgggagaaattcaaatgcagatacactgtggtgccagaagaagaaaagctgttccttcctccaaggataatgtccaaagtagtgcacactgatttaggcctatgatgcattgaaaaactaagtttccacaaaaaacattcaataaagggaacctatccttctcactgtgttcaacattgtctaaaggcataaaggcatcaaaaagatacactgtttctgggattgcttctttgctaactgatttttccttccaccacgacgtctaagattaaaagagaaactgatacttaatattcagaatctggatatcaatatatggttgactccaatttcttaaactgattgctgaaaaggacaaccaaatgactgaaataattttagaataaaggaatctgtccctcggcagcatagttgtactcatgatattattgtcattgtaagataatgctggatggctgtgctgtcatcaaggaatattgtcgaacacaagctgtattgttgactgaaacgcacagtagatacctgaaggggaagggaagtgtaagtcaaacttatgaaagtgtattattttctcagttaaaatgtcaaatgacaaagcactaagatatgtctcacactccatgaactgcctgagtgtggtatcatgtgcactctatagaaaacccattggaggctctcaacttccagagatgatgtttaagatatgggttataaaatgctgcccttaatatggtacctgtcatcaaacctaacaaggattttatgaattaccgttaaaaataatgggaaaagtctgcttcgaggggcgcggtggctcacacctgtaatcctagcactttgggaggtggaggcgggcagatcacgaggtcaagagatcgagaccatcctggctaacatggtgaaaccccgtctctactaaaaatacaaaaaattagccgggcgtggtagcaggcccctgtagtcccagctacttgagaggctgaaacaggagaatggggtgaacccaggaggcggagcttgcagtgagccgagttcgcgccactgcactccaggccggcagacaaagtgagactccgtctcaaaaaaaaaaaaaaaaagaaaagtttaaaataagatttcattttttttctgcagcaataaaaagcagctgagaatttctattaattaattaatttatttatttatttttgagacggagtctcgctctgtcgcccaggctggagtgcagtggcgcgatctcggctcactgcaagctccgcctcccgggttcacgccattctcctgactcagcctcctgagtagctgggactacaggcgcccaccaccatgcccggctaactttttgtatttttagtagagacggggtttcaccgtgttagccaggatggtctcgatctcctcacctcgcgatctgcctgcctcagcctcccaaagtactgggattacaggcgtgagccacggcgcccagcccttctattatttatttactacgataaaatgtaatgtattaaataatcctgctacaagagcattttattgcagtgaatacaagactaatgcatttactaaattactaatcctaaatgtattatttcaggtgatattgttacaaaagaagtgtttcagattcagaggctctgtgtgccagggctgctaggccaccaacaagtgaggaagccataggtttctctagtcctattttcttatgtggaggataaaaagagtatcacttaaatattctctcacaccctgaaaacaaatgacaacttaaaaaatctaactttcacttcatgtttaaataagactgccaagacatgactcaaatgagactctcggagaatactttgcattcacttcaaaacttgatcaattgcattctataaatcatctgacctgcacctagccattttcctgctctacccctgctctctgcctagaatactgcttttctctttccttgcttcagcaagctcgactccatctaccctcttggatctctttgtcggcagccacaccaaaaaatgtatttttatacactaattagttgaattcaccactgcttacaagatgctaattcctgcagagtattccccttgtgagaaagtatgcctctccataagagtaagggagggcccttactcttcctacctccagctgctgagcatagaattttgagtaaatccaaaacttcgacaagtgtttgacaattcagttatcatttggaaggtaagtcttactacatttaattacagcaaaaacactactaacagtttactctttataggtattatttaaggtagtcacaaaatagaaacaaatactctaacgtcaggcagcataaatgagagtatgaaattttacaatatttaacaagaaatggaaggggttacttagtagttttaaggtttaatgacaaaaactagaaaataatcgtacctagtaatttagtaagtcaaaaccaaagccttaccatcaaaggtgcagtacccattggatgcggatgcccacgcactgacttcttctgctgtacctgctgcctctcattttaacccattaaaaatactaaagttgttttccttgtagacatgtttcacctccttggttaggtctattcccaagtattttagtttagtttagtttagttttgcagctatcagaaaaggggttgagttcttggtttgattctaagcttggtcgcttctggggtataacagagctactgatttgtgtacattaattttgtctcctgaaactttgctgaattcatttatcagttctaggagctttttggaggagtctttagggtttcctaggtatatgatcatatcatcatcaaacagcaacagtttgacttcctctttactgatctgcatgccttttattgttttctcttgtgtgattgctctggctaggccttccagtagtatgttgaatacaagtggtgagagtgggcatccttgtcttgttccagttctcggggggaatgctttcaacttttccccctttcagtatcatgttggttgtgggtttgtcatagatggcttttattatattgagctgtgacccttgtatgctgattttgctgagggttttaatcataaaaggatgctgcattttgtcaaatgctttttctgcatctgtttagatgatcatgtgattttttgtttttaattctgtttatgtggtgtatcacatttattgacttgtgtatgttaatccatccctgcatccctggtatgaaacccatttgatcatggtggattatcttttttttttttttgagatggagtctcgctctgttgcccaggctggaatatgcagtgcggtgatcttggctcactgcaacctctgcctccgaggttcaagcgattctcctgcctcagccacctgagtagatgggattacaggtgagtgccaccacacccggctaacttttgtatttttagtagagatgggacttcaccatgttggccaggctggtctcgaactcctgacctcatgatctgtccgcctcagcctcccaaagtgctgggattacaggtgtgagccaccgtgcctggccggattattttttgatatgccgttgggaactacaaaacgttgctgaatgaagtcatggacacaaacaaatggaaagacaccccatgctcatgaatgggtagaatgaatattgtgaaaatgaccatactgccaaaagcaatctacaaattcaatgcaactcccatcaaaataccaccatccttcttcacagaactagaaaaaacaatcctgaaatttatatggaccaaacaagaactggcacagccaaaacaaaactaagcaaaaacaacaaatctggaggcatgacattacctgatttcaaactatactataaggccatagtcgccaaaatagcatggtactgatataaaaataggcacatacaccaatggaacagaatagagaacccagaaataaactcaaatacctatagccaactgattttcaacaaagccacctaaaacataaagtgaagaaggtaaaccctattcaacaaatggtgctgggataattggcaagccacatgcgggagaatgaaactggatcctcaactctcagcttacacaaaaatcaactcaagatggatcaaggacataaatctatgacctgaaaccataaaagttctagaagataacattggaaaaacccatctagacgctggcttaggcaaagacttcatgaccaagaacacaaaagcaaatgcaacagaaacaaataggtgagacttaactaaagagcttctgcacaggaaaaggaacaatcagcagagtatacagacaaccacagagtgggaggaaatcttcacagtctatacatctgacaaagggctattatccagaatctatgaggaactcaaacaaattacaattacaaaaatatggaaccagcccaaatgcccatcaatcaatgagtggataaagaaaccgtgatatacatacatatatatatatatgaggaataccacctcagccataataaggaataaattcatggcattcccagcaacctggatggaagtaagactattattctaagtgaaataactcagcatggaaaaccaaatatcatgttctctttcatacgtgggagctgagctatgaggatgcaaagccataagaatgatacaatggactttggggacttgggggaaaggctgggaggagggtgagggataaaagactacaaattgggttcagcggatactgctcaggtgatgggtgcacctaaatctcacaaatcatcactaaagaacttagtcatgtcaccaaatgccacctgttcccccagaaacctaaggaaataataaataaataaataaagtacagcatttttctcagcaaacataaaataaaacaaagactaaagttcatatttttcactctccttttgggcaggacaaattttagataggtttttaaagaattagtaacttttttcctttttccgagacagggtctccctttgttgcccaggctggagtgcagtggtgcaattatagttaactgcagcctcaaactcctgagctcaagcgatcctctgcctcagcctcctgagtaggtaatacgaaaggcgcatgccaccaggcctggctaattttttatttaacctttttgtagacatgaggtcttgctatgttgaccaggctaaaaatgaacaaatcttaattaacttaaatatttctaacactttgggcattcaggaaaacagctccatctatgttgtgaagtaatgggaagtatatggcagtggataaactttgaatgaaaatattaaacaaggccttaggagaaaagtgtaatatgcttattatagatacattaatttaaaaaattctctggcttaatataattaattatactcaaattagattttgatttaaacacaggtcctaaatttggattaaatataatagattgaccacaaatttatttcgtctccctccggaagcctcattagtcataaaataaaggttacacccatgaccagcacagaaggttgacagagataatttttaataaatgctgagacataaaaagtagataaaggagtggtaaataacacagaaacacaactttggtgcctacagaaagtgactggaacagaagcgagccagtttatcttgcagaactaaaggcaggttgtgaacttacaggcaaatggaactttggaaagtagggtaaaatgtgaaaaaaaaaaaaaagccagcaaggtcagttgcaaatctctaactagagccccaagtccacctgtccttccatctgacaagaaacttagatgtgtgttctctggatatatcaaacctgagaatttctggctcagagataccatggcttaaacctgagatataaagaaaactgtacaccaaaaatggaactccaactttcttcgctaactctgtttttcctttccaggcctgcttttactttccaggcagaaaattgggagatccttctcagaagaaactgaaatgtcttcaataaagatccccagataatacactgaggtctcccaaatgaaaagctagtcaggcttctaaggcctcacactgagtgctatcagttaacagaaatcctgcttccaaataaagcaggccagggaccaccacacattggagggaagcctccaagaaaagagatcaaaacaatagaaaaaaggaattgataggaccagtcaaaatcaggagcaaaactttaaaaaaaaatcttaaaacactctcaaaaaatataaaattcaatagaaatggtagaggataaagtcacagaatatcccagaactagaataaaaagacaaactgaaaaaaatacaaggggaaaaattaaaaatcaatgcaggcatattggtctaagcagcctagcatctgaataacaagactatcagtaaaaaagtaacagagaaaataaaaaaaaattctcaagaagagatagtctgcaggtttagtagcctcaataaaatgaaaagatccccaacaagctgttataaaatttcagaaccttagagagagagattctaaaaagcttccacagataactaaaacctggttgtaaataacgtatcacacactggcaatagattcaagaacaacactgtaataagagcacaactgcaaaatgtcttcagaaccacaacatttagattcaacctagaggtgtactctctatcaaagaggagggattttaacatctccacacaggaaaatgtgttcaagtacaactagagacgataacaggacagaaggaaacacagaatctaggactcaggtgatcccacacaagacagcagttacgtgagataccaaaagactttaaagagttagcccagaaaagcagacattgagcatatctagggaaacccacgctatattgaactaggatgacaaaaggccaaagaaagttgccccccacacaaacataaaaaggaacagatgtgttttcgcagatggaaaatatctttgaaaggcatgtgataaatgctacaatacttgggggaaaacagctgttagaaaacaggcaaatgaatatagtcagaaaattagcttcatgctaaaaaataatggatgtgaaagcaaacagagcacccagaggctacttaacgatatttggatagataaactaatgtaggctaggaaaaaagaagatccaggagaattgcagaagtgctcagatttcagaactgtttcagagacaggatgaaggacatggaatgcagaggcacagtgaaaacaccatatgacttagcagtgaataatatttgcagagtcataatcatgtaaatattactgatttaattaaaaagtgtgctacaattggaagaaacacagggagaaacataagatcatggtgtagcggggaaggtatgcttttacctgctgtgacagaaagtcaatagacagtgctggcaattaacttagctattctatttttgttctttcattaaaaataagattaaatatttaaggcaattttttttttttttttgagacagagtttcgctctgtcgcccaggctggagtgcaatggcgcgatcttggctcactgcaacctccgcctcctgggttcaagtgattctcctgcctcagcctcctgagtagctgagattacaggcatgcaccaccacgcccagctacttttgtatttttagtagatacagaatttcaccatgttggtcagggttgtctcaaactcctgacctcagatgatcagcctgcctcggcctcctaaagtgttgtgattacagacgttaaccaccatgcccagccttaaggcaggtcttttgaaccggactattgaaatttaacttaaatgtcagaaatctttaaaaggtggacacgctaaactaagcacttttctggataaatttaatactcaggaaaatagaagagatttagaaaatccacaaaaagaggtccatgctaccaccaccaggtccacattgtaatttaaagaaatcaagagagacatccttttatgtcaaactatcaatttcttaactatttgagtgtttacttacatggtttgtacagttgcttcttcttatttctacaactaagaataaaaaaaaaaaaactggtcacttctgatacaaataccataaaataaaagtagttgttaacatcttactgattactcctatgaaaaatgagacaaaattccattaaaaaaaaattttcaataacatataatttaaattatctggcatgattaatttcataagtcaaatctaaaaacttagattttcatttagtttactttttgtttctattacatacaaatgaaagaatcctcatgtacaaaagaaaagggcaaaaaaattaggccagatgaaaaatttagctaataaaaagtttaactgttgcatatatgagccatgatccattagtattctctcattctgcatttacacatagcttactttaattatcagactctaagagctaacagttctaaaaactacttcctgaccagacacctatctctagatgcaacagaatccctgtaagcatcttgaaccacacttagtggttatctactaatatgtcactaaaaacaaaacaaaattaaaaaatggtctttacacaactggaaagtaacctatcttaaatttgttttcttttttgagatggagtctcactctgtcacctaggctcgagtgcagtggcgggatctcagcgcactgcaacctctgcctcccaggttcaagaaattcttcagccttagcctctggactagctgggaccacaggcacgtgccaccatgcctagctaattgttttttgtatttttagtagagacagagttacactgtgttagccaggatggtcttgatctcctaacctcgtgatccacccacctcaacctcccaaagagttgggattacaggtgtaagccacagagcctggcctaaattttgatgttaaaataagtatacaaacctaattggacatggtgtctgcagcacaaaaaaatcatttttttttccctaaaaagaggccagaataataaaagccccaagagggacttgggccatgctttgtttcctacactgcctctgcctttgatgctgggagggccttgtaggcaaaagttactaccactgaagagtgagggacatggaatagcttttcttttactgcttccatgctctctaggtgtgagaagcccatggctctggaaggaactgggaaatacaattctgatatgttttggatatgttgcccctccaagtctcatgttaacatgtgacccttaatgttggagatagggcctagtgggaggcgtttgggtaatggcagtgattccttatgaatggcttggtcccatccccatggtaataagcaaattctcattacggtaatttaaaagactgtggtactggccaggtgcggtggctgaagcctgtaatcccagcactttgggaggctgaagcgggtagatcacttgaggtcaggagtttcagaccagcctggccaacatggtgaaaccctgtctctgccaaaaatacagaaattagccaggtgttatggtgcccacctatagtcccaactactcgggaggctgaggcaggagaattgcttgaacctgggagatggaggttgtagtgagccaagatcgtgccattgcactccagcctgggcaacagagtgaaactccatttcaaaaaaaaaaaaaaaaaaagagtgtggtaccttcccccttcccctctctctttcaccgtgtggaaccacctgcttcccctttgccttttatcatgattgtaagtttgctgaggccctcaccagaagcagatgttaaagccatgttggtacagcctgaaaatctttgagccaattaaacctctttttgttataaatcacccagccttaggtatctctttatagtaatgtaaaaaatgaagacaaattctaaccagaaataactgactcaagatgggcaaagtctactcaaactataaaaacaaaggttacaaactcccgtgttttactgtgctgcattacttcgcacactattatagaaccctcacttgtattcttgctgtttaagtcaactggaaaacttggctgtgtatggcttgttggcaaataaatgaggatttaacataacattaagggaaataagcaggagtagggcacgtttaaatttacattacatcgaatgaaaaagttaataacctaaaacttttgagtagcatgaacttggatgtggtaaatgaatgtggtcagaggactgtgtaagaggaggcccaaatcacagattcaatccctgatgataaacaactatgttttttaagttgtttaaatgaaaaccaagctgaagcctaagttctatcattcatctttaaagtgtactttttggagcaagggaaaagggattataaataaagataaatccattaattataaataaagataaatccaagaattataaagagaaatccatgactcctccatcacatcacaaattaattgtgttgataaaaagatggcaaaatgtataaacaaaaaggttacacattttcactaacatcataacaactaaaggaaagtatatcacatattaaaataagacaagtgaacatgtgaaaaggtgaaaaatttaaaccaatatgagtttttctaaatactttctataacctgatcaaacaagagattttattctttctcttggcggaaaaaacaatgtcgtctcaccatctgtttgagagttcctctggaatattgtgtttgcctctggattggcagaagggttaaactccaaagctatatgcatagaggaagaaaagaaaaaaagatgtaatcattgataaaaatttatcaactcatttattcgactgctgcatttaggctatttcactatctctactttgattcttatccattgaaatgaatgtatagacataagatagagccaggcaagatggcacatgcttgtagtcccagctactcaggaggctgagatgggaaaatcacttgaacccaggtcaggaagttgaggccagcatgagtaacacaatgacaccctcctttatttaaaaaaaaaaaaaaaaaaaaagaggtaaattttggctttgagttgtgtaaaatcaactttgcataaaataaatcaagatagcagtaagttttaaaagacagtctattttataggcaaaatataagatgtattctagagtttttaaaatgtttaaaaagtaaattcatcatatctgtcacttccatttcattctgaggacacagaaccttagttctcttgagtagctgtcttccatagtcatgtgatatctctaagttttcatttcttcattagcaatacatagggagaacatacacaggccttatttgtattggaaagggccaagtgagacatacataaactgtgttgtaatcctaaagaatgacaataaagagtcatttttgggctctcatccaacactacccatctactaactggtgtgtaacatccatcaggctttccgaacatcaccaagcagagtataagtttacacaagtacttacatgctttgtgtataaaggtacaatcaattaattcacataatgcatttgtttattctaaagcaatccttaaatatcttgaaatgtgaagatagtacttccaagttacaaagtcacactcataatgagtcttaattatcctacctctttaaaaattaagagcccgaccaaagtttaaatagaagagctataagacatttcctctacagtgatgaaatctctggcatttaaatgaaaccaataagccaactggatttaatatgtttatgatgcaatgttttctattttgaaaatttcagtttttattcaagaaccatattattacccagaattacttttacttagattcatctctttgcaaaattttagaggcaaaccaactaattgttttctcttttctaccggctcccatcccctgcctctgccagcagtgtagagactaaaaaactccaactttctttcctttttttttttgtgagacggagtctcgctctgtcacccaggctggagtgcattggcgtgatctctgctcactgcaacctccacctcctaggtccaagcaattctcctgcctcagccttgtgagtagctggaactacagtcatgcgccactacgcccagctaatttttgtattttcttttttagtagagacagtgtttcactatgttggccaggctggtctcgaactcctgacctcaggtgatccgcctgccacggcctcccaaagtgctgggattacaggcgtgagccaccaagcccagccaaaactgtaactttcttatctttgaacaagatgctattgtcaggaggggaagggacaaagggggagccatggcaacaaacactctaacagggaaggtctgccattttaacctgcaatctttatattacacattaaaagtctacattgacgtttcatgtcttttgaaagttttgaccatgaaccaatccccacctctcttttagaacaaggaggtaaataaagtctgttaagtcaccagaataaatctggagacacattttctgttaaagtaagaattttaaagtaatcagagcctcataggtaaactcctttgagaaaccccaaacacacacacacaaccatttttctgcagccccggctgtgacatttcacacctttcacaattattttaagcattctccttttttctttttccttctgtgttcaaattacagttagaagaaactaagcagcttctatcaaggtgacttaaagcagcccattaagaataccatatagcctctcccgtggcaacctccattctgattttaaataagaaatccccaaatatttgaataggaactgtcctgagatttggctactttaacaaaggaaacaattaggcacttacctggttccttcacttaggtaccatctggataggtacaaagaaaaaataagatgggtactgaaaagttgggatatttgagtttttattgagaaaaggaagagaatagctcaaagaagcctaaacaaagtcccacaggataataaacagagctacagacactgttgtctcaccatctgtttgagagttcctctggaatattgtgcttgcctctggattggcagaaaggttaaactccaaagctatatgtatagagggagaaaagaaaaaagatgtaatcatttataaaaatgtatcaactcatttattcaactgctgcttattcgacaagagccataaataaatggccccatgccagcctgggagaatgagatgagagagcaagaactgggcgattgggaggggaggcgaaaagaaactgactggactcggtggggaaagactaaggggtgggaattcaaggcagagccagcttttgttcctggccagcccccgggaaagctggctacaagcagaaaggagctcgaagtgggggatgcctcaaagggaaccttggggacagcagcagccaaaggcaaaccgagggtagatggcacctatcacctccttaccttcaggcatctcccggtcacgaacgtggtgcatgtggaggtcctcaccaacttcaacagtcacctcagcaggctgtacagcagcagccatgggcgctcctgccatcctgtcctcagctcctgcctcatagatctcagattcagagggacacaccgacccctgctgctggtcaaactcgaggctgacgctagggtgcacacgacaggtcagtatgttccccatggggcgcctctactgtctgccaccacctgtgcctctgctcacagctttggccacgcactcccgctgtcctaggccgaggctatgctgcacttgcagagatggtcttcccgctcctcgcctgcccacctcacagcgcggccccgggcaccagccctggccccggccccggccccggccccggctagggctgcgggccaaggcccgcaccctgctgcctcccctgagttgacttgtctgggagggtgaagaccagccggcttatttaataggttgtgaacccaacaagcgctgagagacacaacaactgcctgaaaagagaacagacggagctccttctccttctgtagtcacctacagactgaagcccactggccccaggtgggagcccaggcatgtggcacacaatgccccaccccacacttcacaatgccctccccgacacctcacagtgccccaccctgcctgccacccctccccaacagctcagaatgcccctgccttggctgccccaccctgtggcttatgatgctgctgctctcctggcccctcgtgcagtgccagtgggactaaggttttcattcatcaccagcttcctgagattttagtcctaagaaaagcacagggtagttcattccttgaagccagcttcctctatgagttctatacaaagcctcagtagagtgggtcccattagcaaccaagttgaacaacttttatttgctgtctgaatatagatacacctgaattgttgactgcttttgtaactaaacactcctctcctgtcttccaacgagtggtcatttttgtccgcaacttgaccacagcaatccctggggccctagctctactctcaataaagagttatggctgtgtgttttgaatgacaccttaggacccatcctgcctccacctccttctccataaaatagaaacctaactggcacctccaagctctgaaatgctgaaacttaccaactcccttttctccccgctatttcttccttccatggcagggactttcaggttttctttcttttactaacaaggcactaagcatgattttctcatacaaaatcgagagccataaagtggcttaccacagtcctatttcaataaagatgaatactcgacatctggcaagtagtgtgtgcctgacagtgtccccactgtgctatgctcatttaaccctcagaaacaatctcatgttacagattttacagaagttgttgagatggagaaggtaagtaacctccccaaggtcacatgactgctaagggtggggccatggtttgatcccaggtagtctgaattccccaattgcttaagcatgagtatcagaaagtatagcagtctgttttcacactgatataaagaaacacctgaggttgggtaatttttaaaggaaagaggtttaattgactcagtttcacatggctggggaggcctcaggaaacttaacaatcatggcagagggggaagtccttcaggaaacttacaatcatggcagaagggcaggtccgacttacatggtggccgcacagagagtgggaacatgtgaaggagcaactgtcaaacatgtataaaaccatcagatctcagctgggcacggtggctcacacttgtaaccctagtactttgggaggccaaggcaggtggatcaactgaggtcaggagtttgagaccagcctagctaatgtagtgaaatcctgtctctactaaaaatacaaaaattagctgggtgtggtggtgcatgcctgtaatcccagctactcaggaggctgaggcaggagaatcaatggaactcaagaggcagagactgcagtgagccaagatcatgccatggcactcctgcctggacaacagagcaagactccatcccaaaaaacaaaacaaaaccctataagatctcatgaggacttactgaatatcacaagaacagcatgaggataactgcccccatgatccaatcacctccccctaggcccctccctcgacacatcaggattatggggattataattcatgatgagatttgggtggggacatggcaaaaccatatcagaaagtaaaggtagaagtcaagcttggatgggaaatgacattgtagattattattattattattattattattattattattattattttgagacgaagttttgctcttgttgcccagtgaaattgtttctctaatttcattttcagattgtgtcttgtagatgtatagaaatacaattgataaatgattctggctattaaccttttatgcttcaaccttgctgaacactatttttttttttttttttttttttttttgagacggagtttcgttcttgttgcccaggctggagtgcaatggcgtgatcttggctcactgcaacctccgcctcccgggctcaagcggttctcctacctcagcctcccaagtagctgggattgcaggcatgcgtcaccatgcccggctaattttgtatttttagtagagacggggtttctccatgttggtcaggcccacctcagcctcccaaagtgctaggactacaggcatgagccatcgtgcccagccagattcgtatatttttaaaagaattttttttactttttattttttttttgagacagagtctcactctgttgcccaggcagtggcacaatcattgctcactgcaacctccacctcctgggtccaagtgattctcattcaagtgcctaagcctcccaagtagctgggattacaggatcccgcccccatgctcagctaatgtttgtatttttagtagagatggggtttcaccatgttgctcaggttgatctcgaactcctgacctcaggtgatccacctgccttggcctcccaaagtgctgggattgcaggcgtgagccaccactcccgaacagaacaacatttttttgatgtggattttaaaatgcctccccttctttcaacattgattaagtcccttctacatgccaggcactgtatgtgtgaaatagtcccaactctcaatgagtgtaggcagatacacaaacaaaggcttaaggaggtcagttttctgagaccatactgctggacagtatatgaacctgggatacaaacccacctctatttgacctcaaatttgatgctggggtggttttaattttattctgggaatttcagtcattcaaccataaaaaggtgaaaagtctctgtcagatgtgcgtgtagtggtctgtataataaagactgaaggaagcaaccaaaccaattaagagactttctctaaaggcagagtaatgctaagggcagtggcagtgacaaaagtggaggaaaaagtctgtgatcatttgggagacagaataggaagtgcttggtcatgagatgtgaaagaagaggggaagtagaaggaaaacagagctgctcaggctctgctggggaagactgggtgtgtagcagtgccttcctcctggccgagaatgtaggaagagaaataggtaaggaggaaaagatagttttttactctcagtgtcacattaaaatggaactctctggtcaaaagttgaatataaatctctgtaggctaagtccatttgtgacatcccaacatatgttttcaaaaataacatacacactaaatcaagccattaagcgtaactggggaaatttcctaaaatttacatgctaaaaaatcaccatttttcatttattactttcatggagcaactttgaatctatggttacagcaggtgaggcaccttgtataaaataaagctaatacatgaaataaaaccatttaaaattctattgttctcagagaatggagaaagcaattgaagccatgggtgtggaggtgactgccttgagaagttgtgtatagtaaggagaactgggaagaaagaagacctggagaatagggtgatttgcacggcattaagtgaagcttgaaaaagtgagcactgagactcaagagacatgtatgaatcagaaatggctgctcctgtgagttgttagaaaggagatgatgccttcttttcatatctataacagtagcacctagcacagtgcctgttcaataggtactcgacatgtattatcccaatgcagagtcaaattttgccaggaaggcaggaaagctacaaattagctatggcaacttagtgattgggcttgggtgtgtgtgtgagcgagctggatgtcaggcagtgggcaaagtagtgaactggaggtgagaaaacaatgacacaaactcagggcttctcttcccaagtatttggctgagaagagagatgtagtattaaagggagatatgtggtaaaggaagccttttatttcaagattcaacaaaagcgtgagtatacttctatgttaaagggaaagagccaatagagaaaacacatttttgaggttagaagagaaggaagaactaatgcagaagggccccaaaaggcacaggtgcgtgcaatccggatcagggacagattagctttggattcctacaaaagcaagaagggagaaaggaccatgtgacactagagatatttctggtaaaggaaaggtttaggaaaatatcttttgatgacctttattttaacataatttttttttttttttttttgagatggagtcttgctctgtcacccaggctggagtgcagtggcacgatctcggctcactgcaacctctgcctcctgggttcataccattctcctgcctcagcctcctgattagctgggactacaggcacccgttaccatgtccagctaattttttgtatttttagtaaagacggggtttcaacgtgttagccaggatggtctccatctcttgacttcgtgatccgccggcctcggcctcccaaagtctgggattacaggcgtgagccactgcacccggctagactttaaaaaaaaaaaaaaatactgtgggaaaaaggatattatgtatagaaaagtctacacttcttgatacaactaactaaaaaaagcctgatacactaaacaaaacccaaataatgtcttccctaaaagtgggtaacttgaaaagcaattcgagcaaaaatcaaggagttcaattataaataagtatatcaacaaagtgaaagatgggtttaatttttcccacaaaaagttaaaagaaataacagcagttttagaggaagaggaaaaaataataagaaaattatatgcagttgcaaaatgtgtgactatttacaaactctaacatataactacaaaacggaccagaagaatcattatcataggaagcaaagggtcatttcaaaaatcagaggagggatgattcatatttaatttaattctgtggaaaacatttaagtaacctttgaggacaaaaataggtgatatgttgaaatgcgggaaaccacagtggaaggaaaaagaattcaagaaagctcagtttcagtaaccagtatctagtaaaatcttcaggacctagaggctacaatctgcattaatagtgtctgaagacctagaaatgtcattaaataccattttggataattcttgtagacttgagatgatgtctatttaaagttacaagacagtgcctgtatttctgtattcataacagaaaacaattggatatggaaaagaaactaacatgctatgccacaatctctaaagaaagattagggaagtttcagcttaaagcaagaataatcacaataaagttttacaaccctttgcaagcatatatgaaaaacttacaaaaagtttgtaatgatcttttcttaagctaagagaatggaaaaaatgagaaaaattaaattataaaatgaaactttggtttagaggtaagaaacatttgatgacagtcaagagatcagggttgtacagtgtattatgtgaatgttgtgactcattggtttcatcttggatatcataacttgacattttgtaaaagtgatttttcatgggagttttttcaggtgccctataaagtcctgtcccatgagaagcgaataatagtcttccatattcttgagatatcttaatgaatagcatcttctacagtcttccattgtttagtccttggagagacactcattagtgactgttaaggtacctgagttattaggtgcctgtagactatgcccagtgatatgtgcattaggtacatgctccctagctgcgttgacactgactgaagctgtgaggtttcacaatgacatgtcagccaaatacatatgctcagatttaccatttatcaagaggtcttcacactatcaattgtgcaattatcattctacacacaggcagcgataaagggagtaaaaaaacacagccatggatcgggagactaaggtacctccagaggagtccagtgggtccagaagccctttggatgttggtcagaggctcctcttgggcagagatcacagcagcagccaacaggtctggtgaaatccttaagagttctcatggacaaagtttgtgaaggcatcttagacaagatcttgtctttgctggttttatgatcctctgcagatgggtctattctcattatctcagccacctttcacttcctatcagttcagttcaggtctctcatgatcccaggcagcagtagttgttatcacgtgagttcattcatatatgtttatctctttggggatggggggacaacttcactgtggacttaattctactggagatgagtgaccccattttaagacaacatgatcacaaattattatcacatatcagcagggcagacaatagctatgacctggggctgaaagcaggtaactccatttattctgcaaacattgtcttgattatggtgccagttgctgtgagggatttcctttccaccacctgtttttcacaaggtttgagtctgaactgctaacattctactgatttctgggtgaagggactgactgcaccatcctagcctgtcagagcattcgccccaatacttccactttaagagttttccaccttgtccagaactacagtccattaatcccctcattttctctcttaagagaataaacaggccaggcgcggtggctcacgcctgtaatcccagcactttgggaggctgaggcgggtggatcatctgaggtcaggagttcgagaccagcttcacttacatagtgaaacctcgtctccactaaaaaaaataatcacaaaaattagccgggcatggtggcaggcacctgtaatcccagctactcgggaggctgaggcaggagaatcccttgaactcgggaggcagaggttgcagtgagccaagactgtgccacagcactccagcctgggcgacagagtgagactccctctcaaaaaaaaaaaaaagagagagagcgagaataaacaacccatgtcaagtacacacccacatccctcttatcccaaataccaaacacacaaaaatccaatctgtctccttctacctaagcaattttagatagtcactttctcataattaccttaagctccctgacttgctgctcgtcctttctctggcaaaatctcatccttggatgagcccgactttgtgtttgctcaatgacaccactcacctgaaccagaaaaaatatcaaaaagtggtcagagatatcatcataaattcaaattacttacacaaaaaaattggccctaaatgtttccagaaatcaataaaagttttgtttctccaatgacatcatttcttcagaaacccaacgtgtataacctattttttctatgttcttctaacatttattcaacttctctcatctgatatcttgccaaatcattcaaagagaaaatatatcccattaggcaagagccgaccatattcccatcacctgagaaaatcatatgcacaggatgcacccacctcacctttctctgcctcatcatgtcagaaaaagtacccctccttttgccacaaggcaaatctgagataaaagatttagatggcctgtaattccagcacttggggagaccaatgcaggcagattatttgagtctaagagttcaaaagaagcctaagcaacttagggaaactgcatctctcaaacaaatacaaaccattagcctagcatggtggtgtggtggcacatgcctgtagtcccagctactcagggtggggagcactgaggtgggaggatcacctgagctggaaggttgtggctgcagtgagccgtgatcacgtcactgcactccagccagggtaacagatattttttaaaggatcttctctgttaaaaataatccaataaacaggtggccatgaggctgaggtggctgccgtgcactcaattcctccttaaataaaccaaaacttgactcagtgtaaataataaaaggaaacttaagcttaaccaatcagaaaccaccaactaacatctaactagagaccttccactgtaatgttccaaatgaggccactgctccacttcacccaatcaagtattttctttttcttccacattcaccatataaaattcttcccccaccctccctaagcctctctgtgggacctctgagctgcttgcagtctggggctgcctagtttatacatttctgaatgctcaaatatattttctaatgtttcaaagtggctctggtgtaggaggttgttggtggagtgacccgagagtatacaggaattgagggcatatgagatctctggactctgcactccattttgctgtacactcaaaactactctaaaataataatatatctttaaaaatctataactagcacgtagcccttttcaagcctccaactggttggagccagttcgattaaagctcagaagaaaaactggttaataagctagttctgacccaactggcaagaagcagcaggaaagacccaggccaggggagcatattgcacatgcatgcaccaggaaactggaggaagcttggaggccctttagcctggtcctgagcccgctgaaactgcagttacaggcacagatgcctggggcaccaatctgaatctgccaacatccaaggccacatgaacacaaatgcgcagtctcctctgcgatcggtagctaaggatgttaggccatgattggactaggatgggagatgaactgagaactctggattctgtaggttgttgttgtctcttcccacccccaagcaacaagtgatgaacacacacacacacacacacacacacacatcctgtagtgactaacaggatctccctccaggggatttgcagaaaggggagcagaaaacatcccaggggcctttcacagctacttccttgagccccctttcagactgctgtctagacctgtcgcagcccaaacatcatcaccctgatatgcagaagctggcatccttacctgaaattcaacaccaagaaatgatctcttctactcaacactgatagaaatacctctaagcaacgtcctcattggcaggggtggagtgggggagtttcttaaaaagggaggcctctgcctaccacctagagaacctggaaatttccatctgtgccacaaagtccaaatcactagccactgccccagtgtatggcagattagaacatctctccattagatctgggtttctattccattgagtgaaatggcttttctattacaggaacagaataagggttcaaaagggtcttacaactgaactccagtgtacagtctgcacagacactaggcttgtgcaaatatgacacagcgaggccccaggacccttaagccagctgaatgtactgagtttcaggaaacagtgagatacattcagcaaaacagtgggcttcatgctgaaagaagtcactccaagtaaacacacatcacacacacacacacacacacacacacacacacatacacacacccgcagacaccctagtggccaataggtcctctcaccaaaaacctgtgatcaggagagcagaaagcctcccaggggtccatcactgccctttctggagccccttatcagatggccagccccaggacagcactgtctgatcctggtccagtccaaaccgccatcaccctgtgatgtgggagctggccacttcaccagaacctctgtgtcagaaaaatttctcttccttttaaaatgatgagggggaaccttcagacagtgtctgattagggtgggtggagagaggggcttcctagaaagtcaggcagggcagggctgaagccctctgggttaactgtgtgcttttgatatgaagtcaggtaagactggacaggtgggcgtgttagtgaggggatggtgtagggtgtgctgaagaactccacttgagctctgcacaccagggaaaatgaccataaaacatcccatcttcactgctcagagaaggctagatctgctgtgagctagaaagccatgtgggggcagctgatgagtcatcaaatgggagaaatctgagagccatgtgttccacaggcctctggtccttgttcaggcagcagggcactgtgacatgtggctccttggccccttccagccaccaccttgattgcatgctgcagggaaagagactgaagaccaagaatggggtcttgctcaccatgggatgatggctcagtacagagctgagctatgtatggcccaagaggcagaatgtggggatgacccaggctgagctgggggatccaactgaacatgcacttgctaagaagctgtgggctatgatgccttgggaccccagtctgggtctagaattgtagcaaaacaggctactggtaaaagttcttgggaagccaactcacttttgctgtcatccatgggcaaacaaaccaagccccaccacttcccactccctctgaaagcctcctgcccctctgatcgaccacaccacaatggtgtcactctgtaaggcacaggtagacaaggcatccagccatgaacactccagggcgcacacatgtccagaatacactggttcttgttgagactccactcttccaactcagacagaagctccccaatctcctcagccactcccaacaactggaggtctgaaaactttcatgcatgccgctatggtctaaaccactcgtggcggttttcattttcattttcctgataatcagtgatgctgagcacctttccataatgccttttcaccaactggatgccttctatggctaaatgtctattcaaatccattgcccatttacaaatctgcttttttgtgggcttctttttttctctttttttttcctatttatttatacaagttccttaggtattttggatattttttaaaatgattttcaattccactgcccagttataattttttttttttttttttttttgagacggagttttgctgttattgcccaggctagagtgcaatggtgcgatcttggctcacagcaacctccacctcccagagtcaggcaattctcctgcctcagcctcctgagtagctgggattacaggcatgtgccaccatgcccggctaatttttgtatttttagtagagatgggttttttccatgttggtcaggctggtctcaaactcccagtctcaggtgatccatccacctcggcctcccaaagtgctgggattacaggcgtgagccactgtgcctggccaattatcccttttagtgtttttttggggggttgggggaagaacagagactcactctgtcacctaggctggagtgcactggtatgatctcggctcactgcagcctccgcctcccaggttccagcgattctccggactcagtctcccgggtagctaagatcatgggcacgcaacacatgcccagctaatttttgtatttttagtagagacagggtttcaccatgttggccaggctgttctcaaactcctgacctcaggtgatccgcccacctcggtctcccaaagtgttgggattacaggcgggagccaccactcccggccccattttgtgttttaacatcagtcgacactcgtattttaaaataacaacaatgaatggcggtaccttagaacaaaggaattatagatctttctcttgtcctagtgcagacattttgtctataaaatgttattcacagatgaattcatgagaacattactgtgaattttacatccatatacaagtgtatgctcattcatgaatatttcaataaaataaaactaatagcaaaaaagaattccagagttgaagcagtttcaggaaaaaggagttggcagtatgaagtaaaatagcaaaaaaaatgtttttttaaatgggtatatttgtgtctacaacttttttttaattatagcattagacaatgtgtatatatatacgtatataaagcaatggaagtagcattgttttcatactagtctagaatattaaaatatatgtaatatgtgatcagcaaaataatggccccccaaagatgtccacagattcctagaaccttacatgaaaacggtacatcatgcatgtgattcaggtaaagaccttgacatgaggagactaccctggtgctatggaatgaatgttgtgttccgtcaatgttcatgtgttaaaatcctaaccctcaaggtgatggtattaggaggttaagccttacgggagactctgccctcatgactgggattagtaccttattaaaggcacaagggagcttgtttgttcctctcaccatgcgaagacacagcaaggaggaagcctctatgagaaagcaggccttcaccagacaccaagactgccagcaccttgatcttgcacttctcagcctccaggactgtgagaaacaaagttctgttatttataagctacctggtctaatgcatttccttgtagcagcctgtacggattcggacagtgggctcatgtggatgatgacggtgtctccattcaggactaagtaagcacatgagtccttaacagtggaagagaagggggaaggaaagagccacagagacatgtggccatagaagaagggcccatgggatgcaaggttgctaatggtgagagtggagaagagcccaatgccaaaaaatgcaggcagactccagaatgtggaaaaggcgagaaaaaagatcccctagagcctctagagatgaaggtagcctttccaccacctagattttagcccagtgagatccacatcacactctgacatacaggagtgtaataaatttgttttatgccctgacatactggtagtttgttgtagcagcaatggactagtaatatataaatatatacacacacacacacacacacacacacacaaacactacccccccaccacacacaacataactatctatatatatcctgcccttcaaaactgaatcagataaactacacattagcattaacttagctgggtgtggtggcacatgcctgtagtcccagctacacaggacgctgagagggaggatcacttgagcccaggagtttaagatcagcctgggcaaacacactgaggccacatttcaaaaacaaacaaacaaaaaacacaacaaatctttgattaagctcatttcccaaatttgaagaggaaacaattattagataaagaggagaaaagagaaaggtagagctgctgacttctgtggtggaagcacagacacaggcccaaacatactcctgtcctcctggctttcctgtcccttctcataagggacacaggaacctctcaaactgaaccatggatcacagaaccatactcagaacgcaatacagttttgtctacaattttttatatatctgtgtccctgtctctgcctcccattcccaactcccttactcttgttagaaaaaaatggctattatcaaatatgagtacatccttatatactaatgccaactgatcaccagctggttttcttcttttacaaagtcataaatatttaggctttaacacatcttccaagcaatagaatgttattttccagttcattaacacaaattctatatctaaaatgaagacttcacaagttgatttaaataacatattaacgaaaatcgactggccatggttcaaactgacattttaattaaatgtgatgataggttgagcaacctagcagtactctaaaatgacttttggttatggctttttccatattatgtttaggctgaggcatccctaaatgattcaattgtaattccccttcttaaacatgagatttatctttacaaaataatttattttcttaaaattgcaagttaattctatagttcatgcatacataatctcagtagatatcagctgtatgtgtacacacatacatataggtatttgtatatacacacattacataattaaaaaaaaaacttattagcagggtacaaccacgaagacaaagaggctttgtgtaatgtgatggaaacacaattgcaggacaaacaacaggctgctgtgagggctgtatttaccctttctgatgtaagacttggaaaaacatggatactggatatttaatccccataacagaaaatttagggtgcagacaacttcccacaatttttacagacaatgtcaatagaaatgcattcaatgcagggaatacacagtgtgacagtatacaaaaataagcaggttgatggtttagatttatgagacaagagaaagaaatagtagatgatgtcataattctccttttatggagttatgaaagttcttcattttatataaggtcaggtgctttcaaatgtcaatgagaaaaatatttaaaggaagaatcaaatctaagatgtagagagatctttataaacgtgaacttcaggccaggcacggtggctcatacctgtaatcccagcattttgggaggcctaggtgggccgatcacgaggtcaggggatcaagaccatcctggcccacatggtgaaaccccgtatctactaaaatacaaaaaatcagccaggagtggtgacgtgtgcctgtagtcccagctactcaggaggctgaggcaggagaatcgcttgaacccaggaggcagaggttgcagtgagccgagatagcgctactgcactccagtctggtgacagagcaagactccatctcaaaaaaaaaaaacaactttttttcatgctgagaagatataatcatcaacacattcttgagcacaactatgcacacaggcacttccgcattcacaagccatgctgtgtgcacacactgatgcccctagattccttttttgaagagatggtctcttggtgtgtcacccaggctggagaggagtgttaggatcatagctcactgcagcctcaaactcctgggttcaagtgatcctcctacctcaggctcctgagtagcctgaactataggaatgagccaccatgcccagccaatgttttcattttattgtagagatgaaatcttgctatgttccccaggtgggtcttgaactcttggcctcaaggaatcctcctgccttgccctcccaacatgctgagattacaggtgtgaaccattgtgcccagccaccggattctttattaagaagaaaacttgtttgctgacatgtaggcaatgaattgatgaatagtagttcataaattactaatttacaagtcaatataaatgagttgagtaaacacaaaataacagcataaattaatgaacagtttacgacctcaagtttctttttttcctttaaaacattgctctgacagagactactacttgtccattccatggaaaagtcagaggtggttaaaatgtcagaggtacacttattaacaccttgctgccttttgtgtagcttcctctcagtacttcaccagttgggattgacacacctctccagctgggttcaggagccagacaggagcacacagaacagggaatccaaagccatctctgacaccaaaagcaatgaaaacaaaaataaccaaacatattatcaagaaatgaacaagagatcgatatcaagtacagcaaaaagagaagaaatcacttaatctgccaggctttcattctgacaaaataatttacaacacgcatgtctctatctgacatgtgtgaatagaaaaagaagaggtgacaatagagtagaggattcgtcttccaattgtctctgatctatccaacctttgttacacatcagagagttctccaatttataaataaacaacagagatatgtggcaaccaggacacagagacatactgagagtactgctcagctctctgcctaggcctgattctgatgatccctgacaatgagcactgtgaaatttacagcaaatcagtacacatacacacaaacacacaaaagagatacttcatgggcaaaaagcaccaaagatataaaataaaatgcctgaaagaccataaaacaacttctgatgaaatgctgttttcattttgcagtagtaaaatattcaccaccaaatctacaattagcttaaaaattacaataagtacagtacttttggatcccatctccaattcacaccttatcaacatgtaataatcacactgcatctacaacaaagctggatggactttatgtgctgaatacaacttgcacactaagaaggaaatttgttgaaataatgagaatccaaaatttgtatgccatgctctacttcacaagttaaaagaaaatacaatcatttctatttttaaaatgcattgaaataaaatacagaaaatacagtattctaataccagttaacattaagagaatatatctctaaaccaaagatcttggatcttctagaaacaaaatcagctggtatatatttggataagaaaaaaaaattaagagatcaagaaaggagagaagacgttcgcacagaatcatctccaaaaatggctttctgacgcattcgaccagttttcaagtctatttgtttttcctcctttggcatcaacagcctatatcaccaaggatatgcaaaataattcaatttgtacattaatcagctaatctagaagtggcaatatagtcaatgaaaatacaaagaaacagaaaatgtcaatgaattgcttaagatgtttaagatgacatagcgtagggaaaaaatgatctgataaacaccggaagagttaataaggaaactgaggcatggttccctaacaccacacttcaaaagaacttatagagagaataaaggaataacccttaaaaaaaaaaatctaattttagaaaaaaattgctcaaaagggaagttagggttttatagatcttctggaaagctgattaatttctaagctaaaaaaactatatgaagctttttaacgtagcacaatagataaaagtatgaaaacataaattagaaaaaactaaaaatcataccataagggatggataagttagaatacaggaataacaggccaggcatagtggctcacatatgtaatcccaggattttgggaggccaagtcgggaggattgcttgagcccaggagttcgagaccagcctaggcaacatagtgagaactcgtccctagaacagaacaaaaaaaattagccgggagtggcggtgcactcctgtagtcctagctacttgcggggctgaagcaggaggatcacttgagcctgggagttcaaggctgcagtgagccaagatcacgccactgcactccagcctgggagacaaagtgagaccttatctcaaaacaaaaacaaaaacaaaaacaaagaaaccacaataacaaaaaaacactggtaacaataaaatcatgattacataaagactgtatagaaaaaaaatcctcagaatatagaaataaaattacgtattttacctgtagctatattagaagagagtattcttgtagacaaggatgtctagaaggatacgcaaaaatgaaaacagctaataacactcattatgtcaggcactgtggtaggtagtttatgcacattgtaacaaattatatactacactatctcaaaattttcagataaattttactggaagtcataaatcaatacaacaaaatcagtgttttgcaaacatccactaagcataaaggtatacaaattcccaacccagactgaaaaataattcacataagccacacattagtggaaacctacccatgggagataatacaacataatctaaataaaactttcagagacaaggcatgtggcttctggacagccacaaactccctgactctgctctagtgtttcggccatcaaaagaaagccaagtggcctcaggtctctgaaaaaccaaaaaagcaacctatggaagatggcgtggtatttgaggaatatttgaagtctgttgaaaaatgcatcctgtatttttttcaagataagactcccttgtaatgtcaggtaagtgaagagccctcagagacacatgcacacacaaagaaaaacaaaacgacatagaatgaatcccaccaaaatgtgttatgatggcagaattatgggtgatatgatcttctgtaatatatctttttattaaaaatagaaaaaaagcagacttacccttgattatctatagcctctgacccaagtggtttggaattggaaagcagcatcactcgacttgaagccatcttggcatcaatggtggagtaggtggagatgagactctggaccagctcatgggtgagccccaccttgtcctatcaaggccaccaagaaagggcacgtgaggaaagcacaaagatcctggagagacactggtttcactcagtttctcaaaattatcttagacacatttcctgagaacctttcttaatgccgcaaacaccagagaagaaaatccttataacaaagcttgaaatggatccccatctccattaaacttttccaaagctcagtgagtatataacctgataacctaaacacctagctagaaaaacctcagttccagtgctacaacagtgctagcttttctaacatttttaagtaaccctgcttttaacccaataaaattcaactacagaactaagaaataaatattggaaatccactttaaaacaatgaggagaccactgtgattgagaaaaagaaaaagacaaacgagagctggaaagcacactgattttgtagaaacggaaataagccgtgcaggtgccacactggcagcagtgcccgcgctggggccacggatcaaggaggcatggaggacaggactcttctgcttggtacaatgaaaaaatggtattatttttattctacatattgacaatatgcatttgggcctttattataagtacaagagaaaaatcttcaataaataaaagctgagtacattactttttttgattaagaaatagattaggaaagaataatgagagttcagagcaaagactcctgcctcactgatgcctgaaaaccgtggctgccaccaaggtcaacacagacagcgtctttgtcatacagcacaccctcaactccagaaacaggcgcataaaccagctgctccttcttatttaaacagcacttcttttgttattcaggaagaacacaagggtctgggaggaaactgatgtcactcatggcaaaatgttctacccctggaagacaggacccaaaaagccagcttcaactgacaagaagtcagtaagtatctactgttgactggggggttaaaaacgatccacagtccaagggcttaacccatgaccctaaagaagggcattgtgccacactggaacagtgaccctctagctacaagaggtcagagaagagggattcggtaacacctttgcaggcctacacatagctggcttacttttaaaacctccagcaaggccatcttcccttgtttggtcatttttcacttttcctgagaaatgaagccatcccaagaatcctatgtgcaattctcgtatgttctacagcaagagaatacctggcatgtgaatttggcttttatttttcaagtgtgctcctcttaaataaccataaagtgacacctgcaggtcacatttgatgtttgtttggatatcctccgggtttgtcaaatcttccatcctagaaaaataaactcaatcatacagcagaaatgaatgccaaagttcctatacctcctttcatgtgtcaatgactcatcacactcttgtccattaagcacatcacttaggaactagaaaatgcagaaataaggaagcaccgttcaccatccagaagaggaaaaggggcaggcacacaactgtgtctctaggctgaaagtgacattcattccataagacaccagatgggagatggcgtccacctggggtcagggaagagtgaagaacacattcagaaaatccatttctcgaagagggtgagcctgtgctctgggatttgtactgtggcttggattctggcaggtggaaaaagggtattccaggctgagaaaatcacagcacaaagaagagcacaaaggaaggaaactgaaggcatgcacgaaggactccagcacccgggcacgaaggcagcatcactgaaaactgaggctgaacgtaggatggggccacatcctgtagtcttaaatgcttccaagtcctcccattttcctaaacatctcataattaatttactcccaaaggcacagcatctttgagcaatgatataagtagacattttccatcaactacacttctacccccactattcaaataggcacaaaataaatcctatcactgttctttttctagcctttttagctttgaaatatatggcccaggaagaaaaagtttacaatcaccttttaactgtctgccaggatataagggtgaaaagtttgccatgagaggcctaaacttcataactgtaataaaatggcccagattgtggatttcttggttttgatattctccatgcaccattccagaaaggtagaacagtttggcaacctaaacattaaaggaaaattaaaaattaaatttcaattaaattctcgtcaatactgcaacaaaataaaagctctaaacaagaagcaatcctaagaagggagacttccagcaaagccactgtcctgaggcttccagagccttgctggattctttcaggacttattagaaccacacagaggcagactgctctgcaaccaagccggggcatccatctaagtatggtgaggagagggaggtgaggcctctgagcacagaaacggttctgtggccgatggaccacagcagtatggaaaggaaggggcagtgcctggtcctgtaactgggagaaacttctgatgtactctattaagtcccgactccaaaacacccagacattgcctggtgcagcaggtacggagacaaatgagatacaccaagaggcccagaataaccactctcttgagggaaaccttccagagactgggaacacatacacaaagggaattcaggaggcaattcctagagagacgtttagtaatgtctcttcagtctttttgtttgtttgtttgtttgagatggagtctcactctgtcacccaggctggagtgcagtggtgcactctcagctcactccaccctctgcctcccagctttgagcaattctcacgtctcagcctccctaatagctgggattacagatgcatgccaccacacccgactaatttttgccttttgagtagagacagggtttggccatattgccctgagctcaaaactcctggcctcaagtgatccacctgactctgcctcccaaagtgctgggattacaggcgtgagccactgtgcctggcctctttagtctgtttttaaaggattatactgttagtttctaacaattatttctcttcctacctggtaaacttctgtccagaacctgtgttttaatcacttctttgtcttcttcagttgcttgttatgcttgaaggagtcgaggtgggtgagaactcccagaattttaggaaagccatgtgcttgacagatgtttagaaactcaaacatttccatttcaaacccaaagctggcatctataagcatcagtacctacaagcacaacacattatttctcgaagaaactaccaaaacagaccacctacactaggggttggcaactggcccacgggccaaatccagcccatcacctgtgtttgtaactaaagttttattggaacatagccacattaattcatttacatattgtctatggccgcctgtgcactacaactgcagagctaagtagctgcagaagatatgatccacaaagctgaaaatattcactatctggccctcaacagaaaagtcccactccagactaaatcaaatgactacacaggcatcacccagacagagaaaccaccaccctctgacttgctctaaaaggcaaccataagacaaggccactaggatataaacatccattttaagaattctaatgcatgagaagtaactcagaaaaggctgggtctaacctggcccttacctaagaaatcctaatttaaagaaatgaagttttctgtaatgtatttttaagccaaataacaggtctctgacatccaaagaatgggaagaaagtgataatcaatgaaatatattaaatacgtacagaaaaccaacctcttctttcaatctcctcacagaaaaaaaaaaaaaaaaaatctgtttttttgctgggaagtatacaatggaaacctctaacttgtatgttaatttgtataactcaattgctcagaaatatttgaaatagctaccagtttagaattaagtaaaaaaacagaaagattatgatgaatggtagtctataagaaaatataagcagataagaccaatttttttttttttttttttttttgagacagagtctcgctctgttgcccaggctggagtgcagtggcttgatctcggctcagcgcaagctccgccccccggattcatgccattcttctgcctcagcctcctgagtagctgggactacaggcacccaccaccacacccggctagtttttttgtatttttttagtagagacggggtttcacagtgttcaccaggatggtctcgatctcctgaccccgtgatctgcctgccttggcctccgaagtgctgggattacaggcgtgagccaccgcacctggccaagaccaatttttaaaatttaagacacttcaaagatgcaaaataatttcagaactgattcctggaaacttgtaattttaatattaaagatagttctgtttgtatctttccatggataactaaaaataacacaaaatggaaacagaaatgcccatccttgattaaactaggaaacattcaaaacccaaaaccacagaatatatgaagttgggcttgtaggaaagcacagctgccactgcagaccaaggcagcaagcagagctctccagcaacactggaccagctcaaagaacaggtggaatatcctcacaccacatctgatgccagagtgccaagggacaagcagctggttgtagggtcaggaataaaagggagcaaacagtccctcagctgccaatctttgccatctaagccagtgtcactcccctaatccacacacgcacgtacacacccaaatccacgtattgtgtgtgcctctgctgtactcaggaggctttgacaacccagagcagagcaatcaacataagctagactaaataaattatggtgcatccacagaatggaatgttatattaaaaagaaggaggcagagctacagtacttactgattatataccttcaagtatattacatgaaaagagcaaagcatagaacagtgtataaaataagctaccgtttgtgtttttaaagggtggcatgtgtgtttatatgtatctggaaggatatacatatacatatacatatatataaaggtctgcagggacctgagagaccagaggttacagcaaggaaagagaaaatgcgcattgtgtgtaccgtgcattacagttagagtgctttaccaaatgtgtgtgctccttttgaaaatcttaagatttacataggcatctctctcaatgatggttaagaggctgggaaggggagcagggagggagggacaaagagggaaaggttaacaggcacaaaaacacagttagatagaataaattctagtgtccaacagcacaatagggtgactataatttattatataattcagaataactaaaagaatgaaattaaaatgttcctaacacaaataaatgataaatgtttgaagtgacagatctctgaattaccctgatttgatcatcacacattgtatgcttctatcaaaatactacatgtaccccataaatatgtacaactattatgtatccataataactaaaaataaaaaaatgtaaatgcatctcttaatatgtatgtatttaaaattagaaacttgctacattttaaataaaagagaaacaaatgacttctatgaactattcaatcatttcaagtatacaagtttagtaatcgttacacaactttacattaattacacttatttttactaatagtagcattacatgttcaaaatttgaatgttatttagttttctgacattacaatggcacaactttaaaatctgtattactttttcctttatattttaggagtcttcctaggccaaagtataaaatctgtagctctagaaaaaactaaataaaaatgaaaaaaacaaggtatctgtcaccccacacttcctaatcaatatggcttatttttttgctaattttttttttttttgagacagaatttcactcttgttgcccaggctagagtgcaatggcgtgatctcgcctcaccgcaacctccatctcctgggttgaagcgattctcctgcctcagcctcctaagtaactgggattacaggcatgcaccacctcacccggctaattttgtatttttagtagagacggggtttctgcatgttggtcaggctggtctcaaactcccgacctcaggtgattcgcccactacggtctcccaaagtgctgggattacaggcatgagccactgtgcctggcctttttttttttttttttttttgccaatgtaaaagatagttcatagaatatcagaaatagtgaacattatcatttccataaatgcaagagcatgtacattttccacacgctgagtactgcctgaattttctattgataaactctgaccacttcttcaggcaattcatgtacttactttagcattatcattaaggatgaaggttctagaaccatcaggaacaagggtcccatcttcacacaagttacttaactgctgggaggctctatttcatcttatgtaaactatagataatacctactcacctcaagggtgtatgtaagctaaatttgtagaaagcagttagcacagtgccaggaagggtccaagaagaaatggtacttactatgatatatttgtacatatatatgtatgcatgtaaatgagctcttattagctgtgttcattaaaggttttctccgtcctgtgatctgcttttagattttggaacacatttcattgtgcacattccatttgtattattaatatgacaacatttattactattattattatcatcatcaattcaatcacatctactatatccctgataatgaccatgatccttttaataatcacaaaactctcttcccttcatcacggggtaaataacctatcacaatgctgtaagtctccatcagcaccccaggctgcccctgctcacttaccagatctgctactttagccagatcaatcatcatgttaatgtcacacccacattcaataatggtgagtctgcgctttttacctataagtgaaaagatgaaaattttactttaaaaagaccctgaaaaaactctaaccatcaactcttaattttcattttttaactgcatccagtaaaacaccacatacgtttacaggagtgtaccagaagttcatttttataggcaaaaactggtaaaataaattccatcctgtttttcttcctgtgttctaaatttagataatatcaaaagcctacccagatgaataaaagtgctcaaaacagggaaaattctgactagacaggctccacgataaccatgatcttgctgttcagctgcaggccaatgtcttcacctctatcaaaatttcctgtattcccactatcgctaaaaacatcctcaaacataatgcaacagaatatttacaatgataattatttctaaattaaggtaataagaaaatgatcaagaaaatattggctgggcacagtggctcatgcctgtagtcctggcaccttgggagaccagggcaggtggatcccttgagcccaggagttttgagactagcctgggccacatggggaaatcccatctctacaaaaacataaaaattaaaaaaaaggaaaaaaaagaaaaattagccaggcatggtggcatacactactcacaggaggctaaggtaggaggattgcttgagcctgggaggttgaggctgcagtgagctgtaatcacaccactgcattccagcctgtgccacagagcaagactctgtctcaaaaaaaggaaaataaaatatggatgcgccaaagataaagaaaagcctcaatccaactatattactgcaataataagagatttcagagtgtacattgccattctaccactggatgtttgtttcatcttccctcaaacttggaaaggtcaccatctcccaaagcagacaaattctcataggaaaaagagaaaacgcgcacttccaccagcatgtggcttcataagggcaagcatgtgcacctggcacataggaggtacgtgctgtctgttaaatggtgtgttcgcagtgaccaggcctgtcaggcccttccaaggaacatgcttggcaaagccatagagcagtcaggataaggtatgtatcacatccttatctctgggaacttatccttttatgaagttatagctaacttagtaaaagtaagagagaggtaacatgatatgacaatatttaacatgttccactcaagaaaacaacaaacacacgcatgtccctcagatgacaacagccacgccaagtctgtgtctgtggcggcatctcctacctgacacgatcgtcacagggcctctgatctcggtgaacttctgccaggtgaagttccgaatgaggcattatatcaaagtgctctttccaactttggaggccccgtcaccactaccgctattggtggcggctctagtggagttccatcaaccactggaatatgatgcttttgtgtcttcaaatccagagtcctatttatttaaaaaagaaaaaaaaagtaaactcacttttaaaatagagtaaaaggtatcaaccttataagtagacttttttttagtataattacagatatgagtactttagtatattttatagagagtacaacagacaatataaaaatataagtaacttgtcaattattaacttctgacccctatccaaatcaattgctgttcaataaagatgtaacaagatgacttcaatagtatagagttgaaaattaaacactccttaaatctgactgttttatgagtgatttttatagttttttaaaaaccaaaaggtaaatactgaggcagcgcatcataacagataagagcagaggttctggagttaaatttggctctccgacttactggttgtatgattggaggtaacttgttttcttgacctcagttttcttgtccataaaatgagggcaagaatgattcctactctggtaaggctgctggaaggatttagttgaataacgtttaaagtacactgctaagaatatcataaggactcactaaataaaactatgttagtattacatattgtaatttttgtattttatattacaactttgtaaaacatatccagagggaaaaagcacacttatcaccatagaaacagtttaaagtttaggaagaatcaaattctataaattcttgtatcttgggcaagaaacaccaaccagtgtgcagatgctggaggcaaggcagcttctatggcaagtcttctcacgttttagtaaaagccacacagcatgcatctccatgtcctttggagctggactagacttgtgaatccaaatgtcacctgtgagaggctcctaactatttaaaaagattcaatggaagaaccatcagactgtagctaaacacacctgtgaaaggatcgagacatccacacagcagactgaactgcaaaagcattggcatttctcttctgggcattttcttcgtctcctagctggagatcctgcagatgccacttctttttctttgcagctttgggtccactgtttttctttctgtgtttcttctggtccttagtctccatagtggctatttaccaataacaagtaactctaacctacaaggaagaaggttggggtaaggaggtgggagaagcattttacaatccaggcaatacccagggaaaaacattaaatttcatttatttctttatgaagacatgatgtatttgttcactgaacaagggtagaaactgcttaaccatccccaatttcatttctctctgttatgctataaattagatgagttacctctgctaaggttacattctatggttaagttactttttactcgtctcaagtgtcaacatcaccagtacctatttctgcaaggatggaaatattctatatctgtacttttcagccatttagccattagccacatgtggttacttaaaatgtacttcagagaaactgaaaaaatgaattcttaattaatttcattctaactctaaatagtcacatgtggctaccatactggacagctcagacctagacatcgactggactaacgaagtggtttcctaacttaaactaaaacttaaatttcaataaaaaatttaaaacgtttttatgaacttccaataggatcgcagtattacttttagtacctgttgactctaaaacttctaaattacagctcatctacatacatttgaaaaatagcaatatctgtatgtgtgagatatgactggttctagatgatgcctggaggccccatggacttacagagacccttccagtgatttctgaggtacctgggaatctgtggccaataaattggtagtcactgaatctgtgagtttttttggaatatcgggctgcataaaatctgacagcttgattgagaaaaagcggggcagggtgccatttcattcagttaaggtcctgtattcattccgtttaataaacgtttgtgtctgtctatgatgtgctagccactgtgccagaaaatggatatagctatggtctgattgacagaggaaatccaaactagtatcttccgtgccatgcaataagagctacattgcaaggctgcagagggtgctactggagcacagaagtgagtcaaaggcttcccacagacacacacacgagcggaaacagaaagtctttatatatcaccatatgtcaaggaacactggccgggagttaggagagctgggcactaggaacgctttgaaactgaatagctgtgtgatttcagaggttatattgcttgtctactatattttactgccgaacttgtactgtttctctcccttttcttcttggtgggaaaagcacaatttggggtcaacagattcggctcaggtctaagtcgcctgccgggaccacgtcgccaggaaacgacgtctccccgacaccttccctcccagtccgggctctctgcagggattcatcccgtcactctcccaacgaccctcgggcacacctcaggcagatgcgaaatatgccgctcctggggagcaaagatgacccggaggaccgggggagtaccttcccacgcgcacgactcgcgatcttcccagtgccccagagccacggacccaaccgccgcctaccccagcccgcggcacctaacctgttcacaactgcgactccttaggtccgcttggacaccgccggaaacggaaattcaccctcgcgccgactcgccggaggtaaacaaaaaggcagaaaaaaagggaccgccgcctggacgacttgcaggggacagctggaagaaagactcgtcaacggccgagtgctggcgccggcgccgtctgcgcagtgcgttccaccgggtccgcgtccctcccgattcagccccaccccgccctcggaatccgctgcctcagctcctgctgtggcactccccagcagcttgcacctcgctcgcggagtccttgctgaaggccagggcagctgtgcggcctggcgcgggttacttgatgccgtgcaaaagccaggagacacatttggttctggccgccccggagtcaccgtgcccggggcgaatggactatggctggattgggagaccacttcctcctctgtaaagatgacagacgagggagatctcacgttctgggggtgccctatagccctcttttggccagaagcggtggatcacgcctgtaatcccagccctttgggaggccgaggtaggaggattgcttgagcccaggagttcaagaccaatctgggcaacatagggaggctacgtctctcaaaaaataaataaatacataaataaataaaaataaagccagcgtcgtggcggggcgcctgtggtccctgtggtcccagctactctggaggctgaggcgggacgatcgcttgagcctgggaggcagaagttgtagtgagctgagatcgagccactgcactccagcctgggcgacagagcaagacactgtctcaaagaaaaataaataaataaaataaggccctctttttccgggaccaacagactctgagggcagggacaaactgacccagcctaaactgcctcgccttccctgctcccgggaaaggggttttccctgagggaaggtagcatcttgccattttcttcctgcacagctttgccttcccagggatccacccattgccacctgaggaaatgccttggagcccatctaatccccagcccagctacttgggacgcctacagagactacattgtcagaggatgcatcttcctctagtcttggagggtttcttttcaatatgatcccaccggtgcatgcaaggctcaattctacatcaaaaaactaggcccactcctgtcgccgagacccccaggcttcaggtcctgtcacagtgaccttgttatcacccccagcagcccccaggtattcactctgcataggctatatactgggtgctgcactagggaggctacctacgtggcgcatgcttcccttatccctgaagagcttaggatgttgtaacttcttcacactaggcctcttacttcttggagatgtcagtatctgggtaaataatccttctaacatccttttggtcttatgaagcccattcttgtcctctgccctacctcagcttccccctccctccatgatcagaccttagaccttgtcaggtccaaggactgcaaccctcacagtatcccactctgaccaccacctcctatctagagcaatggagagactttgtaggtgaaagctgtctttgctactggttctcctatgctccctcgcctggctcctgcaggcggttgacttcaccagggacacagtggccagtgcccagcaggtcccactcctctcaccagctccaggcagttttattgtagagtaactcttctgagacaccgctcctttccccagcacctaaggaagtatttctagtaagttccagtggtatagcatcggtgactctcccgacaagcagagggccatggctgggttcctctgatgaggtgcaggggcagggcactaagaggggaggactctcctgagttctctacctgagccctagactagtagctgctcctcctatacttcctactagtctgtgcctggttactccacttccctgttgcaattaacaattccctatgtacacttttcctgttcaaatgactgtgtggcttctctttcctaatcggactctgaccaatacgctatcatttgccaacaactcccaaagttttatcagtgactcagacctctaacctgaactccagctgcctccatgagatatccatttggatgtttaatggacatttccaaagtgatatgccctacagaactcagaatcttccctctcaaaccaactgctcagcagtcttatgatcttagttgatggcaattcagaagtgaattgcaggacacccggtttgtatctgcagagagaactggagaactgcttagtgtggaaaacccacacatttggtttcagaagtgtgtgagtagaaacagttttccttttatgtttgttggatggataatgatgaacctagcaggacacagaaagctaggcagcagtggaactgagaatgaagttatagttaatagcagagaatgaaaaagaaaagacagataaaacattttgaagaaaggacagtaatgtattcccaacaggtaggatttacaggatggagagaagaggcaaagataactacaaaatttctagcctgagagactggtagaaaaaaatggtggtatcaggaacagacaggggttattaagaaaaaggattggatttttaaaataaagaagatctggtgtaaaattatcctcaggaaaactggaaaactaggcatgtacttctctccatcatgcccttgcacagtgcagtccttctgcctgtccatgcctcgcctccccctccctaggattcctcttcctctcttaagacccatctcaaatatcacctagacttgtaagtaatttacatgaaactggatacctgaggtatccctttgaaagtttttaataacaagttactgttatcttttactaagtccaactttatattcgccattttaactagcatcatttctgtttccaagaggtatttggtgtgaaagtgcaactaagtttactgttaatcaagatcagaataaaagaatctaccaaaaaaattaacaagatcccccttttaatgcataatctttcatccatcaggctgtaagttaaatacctaacataaaagaaagctgtatgttttatggatatgtacatatataactgcagggaatatgatttggaaggatgtacacttagagaagactggagtcacaagtggtagtcaagggagtcttcagatttctttttgtatttcaattttgagagaaatacatacatatgtattataattttaaatttttaatgaaaaaaagtatttttccttttttttcttgatctgtcactacattatatttttccaatatcagctaaacatttgcttcccagaaagcttagttgtcttttcaaaatttattcaggttaaaataaaagatttagacaatgaattaaaaatctaagatggtatttgcctactttatacagaacagtacattgatgctgctaaagcaattaaagtataatttttctttttttttttttttttttttttgagatggagtctcactctgtcacccaggctgaagtgcagtggtgcaatctcagctcattgcaacctctgtctcctgggttcaagcaattctcctgcctcagcctccccagtagctgggatttcaggcgtgcaccaccacgcccagctaatttttttgtatgtttagtagagacagggtttcaccatgttggccaggctggtctcgaactcctgacctcaaatgatctgcccgcctcagcctcccaaagtgctgggattacaggcatgagccaccacacccagcctaaagtgtgtactttttcttagctcctatatgcagtgctccttccccatactgaatgtctgaatttttatctgagacatagtatttcagatggtcattacttacgggtggtcattaatagttcctccctgcttctaaccttcctctcctcattttaaattaaattacgctacattattgtggattagaaagtacattaatattaagtgaaaaaatatgatctgatgagtaagtggcaagagtgttaacgtatgaatattaagagttgttctgaggcctttttgcttttctgggggttctgtgcttgtggtagaactcttggttattttataaatagttcctgaaaagtgagagagtacagctggaaatcagatttctgatgaataaatcaaaccctattaagagaaacaggttcaagtaattttaaaaccatttgaattttcataaatgttttgttaatgattaattataaaaaaaaacagtgactctagctggaggcttttgtgtgtttgcttttgagtcagctaggaaaaggaagaaaaattcaagcttagtcaattgtggttttcactgaatcttttttaaagtaatgagctggtttgttttcttcatcactatagcaacttaagctagtttttgcttttgatttttatttctcctagagaaacttagcatgcactgctcattagacttgggcatactaaggaatatctgtggtaattaagttaaaaatcagatcagtgctttgtgctgtgtatagttgcagatgtctgcatttcactaatattctttggaaacatctggataccagttaacataaaataactgtttagttggtttctgttcagaatagaaggaatgacttaaaagttcccattgtagtacatacgtcattctatccctagcccttcctccagctttactgagattgataaataataaacatcatgggtggtgtgtctttagtttcctctggtgagctggatgcacagattactttgtcagcagggtggtcttgatttttaggccatgtgtctaatggcatcagctctgtggccgacacctgtgtaccaagcccattcactatctagcttagccagccgtggactcctgctctttgttaaaagtatttaccttcattcctactagcacagttgaccaaagacccagttgatcccaaacactagtaatgcatcaatggagtctaacagagttttaagatgtgtgtgtgtgtttgggggtggggggtgtagagatgggatctcactattgttgtccaggctggtcttgcacacctgagctcaagttctcctgcctcagcctcccaatgtgctaggactacaggcatgagccaccatgcctaaccctctaagactttgggatacaaaaacataatttactttccttcatttctggaataaaacatctcttcttcctccccctactttctgttctgtgcccctgtttgatctctgttggtcctgttcaccttcagccttctctgctgaaggaggaaaggcttggttttataaaaagtgacaatattcagaccacataagatccttcttgcttcattttggattaaatattttaagattttctgattttcttgtatgcatatgtatttacctattatttgactttattgaataacttcaaattgagtatatttgaatgggaatgggcattaaaaagtgctaagctttccctgcctttcagaactttgtatgtatatgtcacatcattttgtccttcacattctccagttgtgctaatttttcccaatccattaagtagagtaccttcctttttggagtcttacttttttttttttttttttttttgaggcagagtctcaaaccgtcgcccaggctggaatgcagtagtgcaatctcagctcactgtaacctccgccttagcctcgtgagtagctaggaaatacaggagcatgccaccacacccagctaatttttgtattcttagtaaagatgggggtttcaccatgttggccaagctggtctcgaactcctgacctcaagtgatctgcccagctcggcctcccaaagtgctgggattataggcgtgagccaccacatccggcctccttacttaaatatcttaatgtgccttagaatgtagttaagaattttcaggtgacagtatatttttgatagttatctttggtttccaaacccagagaaggaagagtaactggctttttctctgtgtgggtacattgtgtcttattggagattgttttgtctcaagtattgctgcagactattttattaatgggtgcaactttaaaatttttttttttcagattaacggtttaggtatcccagtactcggtatttgccaatttctagaattaaaaacatgtgtgtatcactggttaactagaaatttaaaatgaaaatgtttcttctttagcccaggcaatatcacttgcattcacttctatcccctccttgtccctactctgttggctccagggcttcttccactaagctggtactttctttatacctcctgtacttccattcactgaacctttattggttcatagcctacagaaaatgcctgtggtgtgagaggtaatttgtgaaactgcttctcttcactgtttagcaggttgagctctctaaatgggtgtagctgggaaagaaaatttaactttacaaacaagaattcctgggttccatccagtggaacatgtcttttgttatacacacacagtttctgactcatatcattccatgacttatgataaaatggacattctgtttacactgttgtgtggaaggaggggtctggttcctaatttttagtaacatctatttctagaatattaggcttgccatttgaatgcttctgtttgatttatgaatatcattggttccagcagtttttagctccctgctaaatgcaagttaaaatttttaagtttctaagttaaaagaaagtaacttttcctccacttaagaaagcaaggaaaattaaaaataatgtagtgatgacttccacaggctctaaaagagcaatgaaaaaagtgatttatgtgtgggagaagaaatactagttcttaattaatacattgttttaccacttcccgtgaatttatgtagaagtaatgaaaccaaggtttaagtcatttgttcaaactcctgtcagtttagactttttaattgctttgttacatgccattgctttgtaatacttgttatagcagtggtaacagttgagatttgcctgtttgaccacttgcagggcaccgtgccagattccccatgtgcaatgttcctcgcagttgtgacgcccatcgtaggagggcggcgttagcacccctccatgcaagcggatggtgcaggctgggtcgcctgggcacagcgcctgactattttcctggcttagtgtagttatcattaaatatgtggtattacttagaagcattttgaataatttgaaaagcacattttagtgttgaaacaatttttttttgagaaaaggtctggctctgttgctggggtggagtgcagtgacctgagcgtagctcactgcagcctgcaactcctgggctcaagcgattctcctgccccagcctcctgagcatctgggactacgggcacatgcccccacacccaactcaattttttttaagatacaaaggattcatcttaatattatttacaatttttttttccttttctgtgggcctcatctgactggaaagcctttcaatttttttattttttaaattgtaaattgacaaattgtagatgtatatttatgaggtacaaagtaattttatgatttatgaatacaacattacataattaagtcaagctgattaacctgttcaccactggaaacaattgcaaatcattatcattttttctggtgagaacatctgaaatttactcagtgattttgaaatgtgcagtactttttgttgttgttgtagaaatgaggtctcactatgttggccaggctggtttcaaactcctgagctcaagtgatcctcccacctcagccttccagtgttgggattacaagcgtgaactaccatgttgggccaaatgtgtaatctattattatttactgtattcaccatgctgtgcaatttatctccaagaaatgtattcctcctgtctaattgaggctttgtgccctttgaccatcatctccccgtcacccccatccccaatgttgtatactgagtcctttcatgatatgtatggaggcttatggtaagttatttaaaagtacatgtatgtcaaaattttttgtggccatagcttttctttctttttaaaattttaagagtcagaatattcgtatattaattcagcatgtatttgagtgcctaatgtatgccattttctatgttaggaaccaggaattaaagcagtgaacataacaaagtctgccctcgtggtgctaacttgccaggtagggaagccagatactaaacacatgtataatgcaaagtcagtaataataaacgatatgaagaaacaagtaaggtaggagaggcaggaaagtgggagtgagaaagaggtgctcttttaaatacagtggtcagggagagcctctcagaatgaagtttttaacagagacctgaatgagatgggggagtcagctatacagatatctgctgtgtgctagaaaaattacctgtaattttgcattctaaaagtttaatgagtacatttatttcacaatttgagaatcaattatatacaagatatagttgtaagcacatactcccctaaatataatttgtttttacagtagaccaaataagtatgttcagcttagaatatgctctttatgatctgtataataaatacattctcttaaaatattattaatattaaggttgatgttttcagaaacatataaaaaagctagcttttaaaattgactagggaagttctctcaaactgccagtccctgagatattgtatattttctatctgaaaaacttttattctcagaattctttaaaagagctgtccctgaggctcccattacttacctgtgactcccagtggaaatcgtacccagcccctcgagaggggctgaatctgttgagagtgggagggtagaaaaaatgctgcagcttcttgtgggtaaacttcacacacaaacacccagtgccccaagcactgtgcagtcaaacatcaaccctgctcagactttcctccttgggattgagaagcaatggattatagagaaagaaaggtggcttagcactccaaaacttggaagggtaattgaccaagaccccccaaagccaaagcagtgggcatccccactttctgtataccctataccaacacgtaatggctactagatacaggggcactagtacctgtctgcttggctacctccccttcttgcagaagtggtgaaggcaatcactcaacctcaggaagggaaaatggctttctcatcttcaaattgaaagaggttggcagtgggtgaggagaataacaagtaaggatctctttcaatatacccatttgaagccaaaacctctgtttagacatacggtattttgaacctggtgactattcattgaccatgtttgtgaattatcagaaagcagaattcttgccaggcatagcggctcatccctgtaatcccagcactttgggaagccaaggtgggaggatcacttgagcccaggagtttgagaccagcctgggcaacatggtgagatcttgactctacaaaaaattcaaacattagctgggcatggtggcatgcacttgtggtcccagctactcaggaggctgaggtgggaggattacctgagcccaggaggttgaagctacagtaagcagtgtctgtgccactacgctcagcctgagcaacagagcaagaccctgtttcccacccctacccaccccctaaaaaagcaagctgaattcttgaactccctgcaaccaggtcacgcaaaccaaaggtaaaaggaacataaaaaagccttctggaaagtgtacagaaattcattgcagggtgatttttgtcttgtgaaatcatagttactgttattagcagcttttttaaatgttttatattcattttttatggtgttctgatgtatgagctgcttcaagtgtttttggacatagcttgggtataaaatgtaaaaagtggatattttcaatttgtagctttcttttttgaaacttactgaaatttgttctaaatatatctccttctttctcacccaccccaacacattttttaaaaaacaccaccaggtatccgttatagcactgatgtgagtgtagatgaagtaaaagctttggcttctctgatgacatacaagtgtgcagtggttggtaggtgatcgcttttcttgctacctaatgagaactctggggaaatatgtttacacacatgttactgttaagatgctatagaaatataccttatcagaactgatttttttttaagttgtactctttaagacctgcatcatttttcaattactctaaattaagatatagcctttttttacgggagggattttttttacgggagggagctaattggattttaagtctagatctttgttttcaattcctcaacatattctataaataagaccaaattatagtagaaggagagtaaataagctattatctttttaaagtggtgaagagcactgattaaatatatattagagccccagcccccgccccagctgcgcgggcccccgcctggcccatggactgcacagcccagcgggcgccttgagcgcggtgcgggtcctcggagcacccccgaggtgagcgcaagcaaggtccggcatcatgtgctaggttattcccagtgcgaggccacacttgggccgtcggagcagcccctcctcacttcaggggtcaccctccccaagacccattgccccatcatggccggggaccggctccccaggaaggtgatggacgccaagaagctggccagcctgctgcggggcgggcctgggggggcctggtcatcgacagtcactccttcctggagtacaacagctggcatgtgctcagctccgtcaacatctgctgctccaagctggtgaagtggcggttgcagaagggcaaggtgaccattgtggagttcatccagccggctgcacgcagccaggtggaggccactgagccacaggacgtggtggtctatgaccagagcacgcggccgcagacagcttcctctccatcctgctgagcaagctggatggctgcttccacagcgtggccggctgcttccacagcatggccatcatcacggggggcttcgccaccttctcctcctgcttccccgacctctgcgagggcgagcctgctgccctgctacccatgagcctctcccagtcctgcctgctcgtgcccagcgtgggcctgaccctcatcctgcctcacctctacctgggctcgcaggaagacgtcctgaacaaggatctgatgacgcagaatggaataagctacgtcctctatgccagcaactcctgccccaagcctgacttcatctaccagagccacttcttgcaggtccccatcaacgacaactactgtgaaaagctgctgccctggctggacaagtccatcgagttcatcgataaagccaagctgtccagctgccaagtcatcgtccaccatctggccggcatctcctgctgtgccactatcgccatcgcctacatcatgaagaccatgggcatgtcctccgaagacgcctacaggtttgtgaaggaccagcgcccgtccatctcgcccaacttcaacttcctgggccagctgctggagtaccagagcagcccgaagctgctggccgccgtgcagggcgacgcgggcaccccctcaggaatgcaggagcctccccccagccctgcggccggggccccactgccatggctgccaccacctacctcagagaccgctgccaccaggagtgcggctgccagggagggcggcccgagcgcgggcaggaagcccccggcgccccccacggccaccagcacgctgcagcagggcctgcgcagcctgcgcctctcctcggaccacctgcaggacaccagccgcctcaagccctccttctctctggacatcaagtcggcctacgcccccagcaggcggcccggcggcccgggcccagcgaccccggcgaggccccgaagctctctgaaagctggacagccagtcggggccatgctgggcctgccctcgccctgcccggacgccgcgcccaggcacacccacggcccggcgcgctatcccgcgcgcggcctgaacttcggctacgcggctgccgggccctggccagccggccagccccggagcctggacgccaccgctcgactccctgaagcgtcctcggtgcttcagccccgagggcgtgcaagggccgggcagggtgctgtttgcgcccttcggccgggcgggcgccccggaacccaacggctgcagcgacctgccacggcgggaggcagcaagggctgagcccgggacgcgcggaccagctggtcagacgagctggccccggattcgcacttcaagtgctgcagctgccagatggagttcgaggagggcatggtggaggggcgcgcgcgcagcgaggagctggccgccctgggcaagcaggggagcttctcgggcagcgtggaggtcatcgagatgtcctgacccctccgctgccctcggctccgccgcccgcagctgggcagttataaatatatattatatataatgcaaagaaaggcaaatggttttactgcgatttttatccagaagtaaatatttcgattttttatttatttaagctgttcattctggcactgatttggcaacagtgcgggtggtcctcgagctctatttttactgtctggtatttaaaccgaaacacgcgtttctaagcaataagaggccaccttcagtcgcaagttgcaggccaggcctggggcccctccctgttcccccgccccaggaaacactgctgacatttgcagaggctgccgagctttcgtgaactttttacacaagagaaagttgaaaaaaaaaaaaactttcttgccacaaaccgagccgcagaaacacccttcttcccccacccaccgcccctgctctctcccttcgggctccgccccaaagccataggctgggggagcaggacctggtgtgccccagagaggtgcggccagccctccaccagctctaggcaccaaatcttggtggcagggagggcaccccgctgcccgttgccccagagctgttccctctcaggggaggacatgcattgggccccatggtgccagggcgttgagaggggctgaggaatagaacagtgtgtgtaggggcttggggcagggggttctggagggtcagatgaggcggagcccaggggaggatgggggtgttattaatgccccaactcctgccagagccccagtccagccactgagtgcctcagaaaggccattcccagagggctgcggccctcccttctcctttgcccctgcccccagagctacctgactggcagggcggcactactgcaggagaggagcttggcctccgggggtcaggcaggaggggggcctggctagcctgtgctggctccactgggcggggagccctggaccgccaggtatgaggagggggtgggcttagggtcctgttccaggtccgtcccccacctagcaaggccccaggcaggacttggaaaccaggtgtgcacctgcaggctgaggggctccatgagcaggtgctgcctcgcacagggagttcaggcgccagccaagcccctgtgcttctggggtaggcctgcttcacttagggagcgctgcctcaaggcagataaagcccccttgttgacccgacctgcatgggggcctctcaggagagaaactctcgtgcgcccctttcccagggcgccctctttctagacagcattccagcccccaaacacaggtggcttttgggcccagatgggtcagcctgctgctcctggcccataccctctcaggccgttgggactcctgcccttcagatgtcctagggtctaggagtgggccagtcaccctgggaagaggccaggggcttggcaggaggggcggcccaggcgggacccagtcctgagtcctggagcagggccagggaggcgcccgccccaccccagccagccgccttctctgctgtttcttctatttgttcttcttttcacccacagccttgtgttcctgtcaaccctcctttcagcaaaagtcctgttcccgttccctctgtccccacccactcctgttccccaagaaaataagctatcattgttgcatttgcaatctatggattagaggtttaagtatttattattattggttaattattattatgttttatatatatatattagaacttggctagccaattttattgaacaattcctgttcaataaatgttgtttaaagtacagttgagaaaacgatggtaggtttatttcttgaactttcagaaattcaagcttaaagcatcacacgtttttctaatatcatgtggcgctttctgtcattttacttttttaacctttatatggaatagcaaccatcaaccttctctttcagatgtgccgtttgggggtgctaaagctggtgttaagatctatcccaagaactataccataagtatgaaagtttttgtttttgtttttgtttttgtttttgcttttttgacacagagtcttgctctgtcgcccaggctggagtgcaacggtgcgatctcggctcactgcaacctccgcctcctgggttcaggcgattctccttgatccagtaactgggattacaggtgcatgccaccatgcctgactaatttttgtatttttagtagagagggggtttcaccatgttggccaggctggtcttgaactactgaccgcaggtgatctgcccaccttggcctcccagagtgctgggattacaggcatgagccaccgcacccggcctcaaagtgatatttgtgcacacagtgcatttatgaaggacttgaaattactgggcttctctgtatcccccatatcagtgaaatcaatagtccccattgcttttcaaatggaatgaaaaaagtaaagaattaactcattgagtgttttgccatataaaggtcacctacttaatatctatatcctttatcattttctgttttgtttggttttgtttttatgagtcttgttttttttttttttttttgctttttgtattattattttcttatttaaaaggtaattaatatcttcatattattagacacctatacccatatttaagaagtactgtgatctggctgggtgcggtggctcacgcctgtaatcccagcactttgggaggccaaggcaggcggatcacgaggtcaggagatcgagaccatcctggttaacacagtgaaaccccgtctctactaaaaatacgaaaaattagtccggcgtgttggtgggtgcctgtagtcccagctactcaggagactgaggcaggagaatggagtaaacccgggaggtggagtttgcagtgagccgagatcatgccactgcactccagcctgggtgacagagcgagactttgtctcaaaaaaaaaaaaaaaaagaatcactgtgatctaattagccaggcatagtgacgcacacctgtaatcccagctactcgggaggctcaggcatgagaactgcttgaacccaggaggcagaggttgcagtgagacgagatttcaccactgtattccagcctgggcaacagagcaagactctgtctcaaaaagaaagaagaaaagtagtactgtgatctgaagtttttaggtcaggatctcatgctagtgacaaatatcttaactaagccaataaaaaccttactttttatcctgtcagttccaagtaaattcaaactggttgtcacaatgctttacataatactaaattatctatatacaaacataaacagatatgatttttattctctttaaaattcaccatttagatggaatataattatattacaattaatcttaattaagatttggtatatttttcagtggggaattaatagaatgggaatttgagtcctggttctactatcttgtttttataacctacttttttgatcccttattttctcacctttaaaatggcattgcctaccttatgagttgttctaaggatgagaagacatgaaaatgtactataaatagaaaataagatgctagctataatctcaagcgatttttgtatctttttttatttttattgttttcttattttacaggataacgaactggaaaagatcacaaggaggttcaccatggagctagcaaagaagggctttattggtatgtgtagccacatagattttggcataaagtgggaacatctaaaaaaatctttttttttttttttttgagacagagtcttactctgtctcccagactggagtgcagtggtgcaatctcctccacctcccgggttcaagcaattctcttgtctcagcctcccaagtagctgagactacaggcatgtgccaccacacccagctaattttcgtatttttagtagagatggggtttcgccatgttggtcaggctggtcttgaactcctgacctcgggtgatccacccatctcagactcccaaagagctgggattacaggcatgaaccactatgcccggcctcctactatttgtgataggagcttttgccaaacatacaacatttttgaagacactgatcttcgtttgcttgatgtcttcgtatcttactattatctgtgtttatatgttctttgtgtgtgatctgaacattctttcctatgatatgtaaatatttgtcatttaccttctaattttcaggcagtttaaacctctctatacatatatttttaatctagaaggcttctaatttgtttgaatagaatatacataattatttaataaaatgcttgccctatcagtatagttaatagaatgttaatagttacttaataatataatacttgccctatcagtatcagtatagttaaacaaaataaggtctacttaaataggaaataaagtgtatttttctctactttctttctcagcatttcccccaccatggacaaatgcctatgaaattaaactataaagtctgggcatggtggctggtgcttgtaatcccagcatttttggaggttttggaggctgaggtgggaggatcacttgagcccggaagttcaagaccaccctaggcaatatagcgagaccccgtctctacaaaaaatgaaaatgttatccaagcgtgatggtgcatggctgtggtcccaactactaagatgggaggatcccttaagcctgggaggttgaggctaccatgagctgtgatcatgccactgcactctggcctaagtgacaaaacaagaccacatctcaagaagaaagagaaaagaaataaagctattcagattcatttttaggaaaaaagtcatgaaataaatgtcatgaaataacctaatatagaaatacagtaagtataggtaactctaaaacttgactagatttggcctgtctttcataataaaaggcatttgggcctttgacgtgccgcatacccagcactactgtgaatttgtgcatcattacgaggagcctattaacatgagtgaactatctcactcacacttttataggagtacctaccgattctgagatatggtgaattgaagtcatgttcagcctgttaatagccttcataattttcaaaaggtctttcctcctcacctaaatctcaaacacattttatagtcttgaatggtttcagactttattcagtcatatttatcgcccatatctgcaatatctccagctaaattttatcagtcttgacaagtacctaataattccaaaggtcaaaaagtgattcattggaatactgaaagaaaacacagcttaaactctagtaacttgatttatttgcctaattcgcaaaggcctcattgacccatgatgcagctaaattgacgtcttggcccagacagctttgaagcctaggaggcaggcaaagggagttttttctctcacttctcggcaaaccttcaaattcgatgctatttatctgttatttcctgacactccacagagagtgtcagattgaggctcagacctgagcctgagccctgatcctatcacatgtgtgtttagcatcagcttgtaaatttctacaaaacaaaacaaaacaaaaaaaaagaggctgggattttgataggaattgcattgaatctgcacaccaatttgtggagtattgccatcttccccaccctccccaaaagggttttgccctttcacccaggctggagtaccaggcagcagtcactgcaaccttgacctcctgggctcaagcaatcctctcacctcaccctcccaagtagctagaaccataggcgtgcgcaactgcacctggctaactttttaattttttgtagagacatggtctcatcacgtatcccagactggtctcgaactcctggaatcaagcaatcttcccacctcagcttcccaaaattctgggattatgggcatgagccactgcacctgaccagtattgccatctcaaccatattaagccttccaatgctgaatatgagatgtctttccatttatttaggtctctgatttctttcaatgatgttttgtagttctcattgtagaagtcttacaactaagtattgtattccttttaatgctattctaagtgacactgatctatcgttttcttatgatgtctttgtctagtctttgtatccagacaattctagcctcatggaatgagttgaggagtgttccttcctcttctgtttttggaaaagcttttgaaaggtcggtgttcattcccttgtgtgagtgtaaatatcacctatgtaaagttctgcaggaccctgatgtctccacccttctcatccccttatatctctgtgcaccaaaattaccctttcatctcctactctatagtcacatgctgttagaaaagttgcttttttaaaaaagatgaacttctgcctcagaccgtgctctctatataagaatttacctgttaggccagtcgcggtagctcatgcctgtaatcctagcactttgggaggccgaggcaggcaaatcacctaaagtcaggagttcgagaccagcctggccaacatggtgaaaccccgtctccactaaaaatagaaaaaagtagccaggcgtggtggcgggcacctgtaatcccagctactcaggaggctaagggaggagaattgcttgaacctggaaggcagaggttgcagtgagctgacgtcatgccgttgtactccagcctgggcaacaagagtgaaactccgtctcaaaaatataaaaattaaaaaaaaaagaagaacgtatctgttattcaggagctacttgtaatctgtgcatcccaatacattagttttgtatggagcagaaaactagtaagcctaataattgataccttgtgattttgttttgggtgggtgaagctgtttcatgtttaacatgtatagactgtttttgagaaggattttatcattatatgtttgtgatttacaaactgtgtgcttcagacttgccacttgccagagcccttctccaattggaattgttttttgtttttgagacagtctcactctgtcgccaggctggtgcaccgtggcgtgatctcggctcactgcaacatctgcctctgaggttcaagcaattctcctgcctcagcctcccgaatagctggcactacaggcgcgtgccatcacgcccagctaatttttgtatttttagtctacaacggggtttcaccacgttggccaggatggtctcgatctcttgacctcgttatccacccaccttggcctcccaaagtgctgagattacaggcgtgagccaccgtgcccagccagcttttttgtttttaaaatatattgtttaatcaagatgggatctcactatgttgcccaggcttgtatcaaattcctgggctcgagccatcctcctgcctcagcctcccaaagtgctgggattacaggtgtaagccactgccccagcctagttggaattgttgtttgaggtaacaagcttacttaatcctaaagcaagcataatactttcgtagatgcctctagaaagattcgggaccaatttgtcatttgtacattgggagaaaaggagtggttaaacaaagttttactgacctccagcagaggtatgtcactaaaggaatggaaagtgagcaaacaggagctggagagcaccagagagcccttttgtcagtggatgaggctagaatatggcattaatccttccaagtgctgtgtggggttagacttctcatgaaggataggtttgggtaggttagacttcatgagattttttctgtttttaagttttttgttgtccttgttgacttcatgagatttttaaggtgactaagggaagggtgctaagacatagagttacagattaggtgggaggtggagagggttggggtataaaaagcagtccttgaacatttcaaagttgtcttataccagccctgtatccaatatatcacatcttgttcaaagaagttgattatctaggccttgggcccctgagttaaagaaaaacattacagtatactgattccgtcgactaaaaagtaaaatttataggaagaattgagtacagtccttagaaagaactttaattattttatggggggacataatggtttaatagtttaacctctttttttttttttttttttgagagacagagtctcgctttgtcacccagactggagtgcactggcgcaatctcagctcactgcaacctccgcctccagggttcaagtgattctcctgcctcagcctcccgagtagctgggattacaggcacttgctatcacgcctggttaatttttgtatttttagtagagacggggtttcaccatttggtcaggctggtctcgaactcctgaccttgtgatccactctcagcctcctaaagtgctgggattacaggtgtgagccacaacatccagcctaatagtttaaccatttttaaagttgtgtttttctttttgtaaagatgagtttctattatacagttgaaataatatagaaagttataaacaatatatatatggtgggtagaaagaatggggaagagaaagaaaattgtaagtgggaacatgttatacatgttgtatgaaacctgcctttttccatatgtatgtttgtgataattccaagtaatttacatgcatatgttatcctttttaatggctgtttagtactttgcataggtataccatagttcatttaattgacatacaagataattagattgtttttatttttactatgtttgagaggagtatttctgcacctttacggatttgagtgagcatcacttaacatgtttttatcagagatcttactgtagccgtcagtagtagtgcagtcagtgatttctgttattgcctgtaagctaatttgttagcctaacacttcaatttgctatgatctgaggaactgaaagctaaggcctaaaattttatatgtgctaagtgtcgaataataggtcaaagctgcattcttccacaagtaaagataatatggggcttaacacaattgctttagcaatgtgattttctcccctttttctctacttggtaaggagggcttatacccccactaagcaggcacatgcctgtaatcccagctactcaggaggctgaggcaggagaatcgcttgaacctgagaggcagaggttgcattgagctgagattgtgccattgcactccagcctgggcaacaagagtgaaactcaaaaaaaaaaaaaaaaaaaaagaaagaaagcaagcaagaaagaaagaaggaaggaaggaaagaaagagagagaaagaaagaaaagtaaatctgtggatattgtacaaaagattgttttatgattttttaattttttaacataacttttattgacttgtatttgtatttttatcaaacatacttcatttgtttatttatttattttgagatgaaatctcactctgtcacccaggctggagtgcagtggtgggatcttggctcactgcaacccccgccttccaggttcaagcaattctcctgcctcagcctcccacgtaactgggattacaggcatgagctaccatgcccaactaatttttttattattagtagagatggagtttcaccatgttggccaggctggtctcaaactcctgacctcaggtgctccacctgcctcagcctcccaaagtgttagtattataggcatgagccaccgcacccagcctcaaacatactttagacaatttttcacctcagcactattgacattttaggctatgtaattctttgttatgggggctctctctgccttgtaggatgtttagtaatatccctggcctctacatattagatgtcaggaagacccctcagttataacaatgacaaatatattcagattgccaaatgtcccctgtggagcaaattcatcccttgttgtgaactgtgatccagagagccaaatagtgatacaaggtttattgttcacaatagctcgtcccctccaatccagacatctgcctcaccatattccactccccagaggcaaccactttcaacaatcttaaatgtttcatttttattctatttaaagcctttgctcatttttaaattgggttttgtccacattattgagtggtaagagttctttatatactccacagccagttgtggtagtataggcctatggtcccagctactcagaaggctgaggcaggaggataacttgagcccagaaggtcaacactagtctaggcaacatagcatgaccctgtctctaaatgagtctttgaagtatatatattctaggtaattgacctttatcatgtatataatttgtaaatatttcctctcaatctattagttgtcattgcgctttcttgatagtctcctttttaatcttgagaaagcataatttatttttcctctggttggtgtgctttaggttgtatgtaagaaaccattgcctaatccatagtcatgcagatacatccctatctttttttttttttttttttgagatggtctcgctctgtcgtccagattggagtgcagtggtgtgatctcatggctcattgataactgcagcctctacctcctaggctcaagcaatcctcccccttcagcctcccaagtagctgggactatagcaccagctatagtcagcctcccaggtagctgggaatatggcaccaggactatagcacataccaccactaagcacagctaatttctgtattttttggagagacaaggtctcaccatgttgcccaggccagtcttgaactcccaggctcaaacaatcctcccacctcagcctcccaaagtgcaggattacaggtgtgagccactgtgcctggcctagagagatttttttaagaaatagtgaccaaaaatatcccacatttgatgggaattgtgaatctacacattgaagatgctcaacaaattcaaagcaggataaactcaaagagatccacactgacacacattataatcaaattgtagaaagctaaagacagaaaagcagcaagagataagtgattcatcctgtacaagggatcttcagtaagactaacagttgcttatcagaaatcacggagtatagaaggcagtggtggtgtgctgggcatggtggcatgtacctgtagtcccagctgactgaggctgagacaggagaattgcttgagcctgggaggtggaagttgcagtgagctgagatggcgccattgcactccagcctgggcgacagagcaagactccatctcaaaaaaaaaaaaaaaaaaacagggttggggaagctcagcatggtggctcatgcctgtaacttcagcacttttggagactgaagtgggatcacctgaggccaggagtccacaaccagcctgggcgacataaggagaccccatctctacaaaataaaaataattagccagacaaggtggctctggcctgtggtcctagctactcaggaggctgagacaggaggattgcttgcagccagcagtttaagactagcctggacaacatagtgagaccccgtctctacaaaatataaattaaaaaaattagctgggcatggtggtgtgcatctgtagttccaactactcatgaggctgagacaggaggatcgtttgagaccagaagttggaggttacggtgaggtatgatcataccactgcactccagcctggttgacagagcaagaacctgtcactaaaaaaataataaatgaataaaaatataagaatgcttggcctggtctgggcgtggtggctcacgcctgtaatcccagcactttgggaggccgaggcgggtggatcacctgaggtcgggagtttgagaccagcctggccaacatggagaaaccctgtctctactaaaaaaatacaaaattagccaggcatggtggcacatgcctgtaatcccagctactcgggaggctgaggcaggagaattgcttgaacctgggaggcagaggttgcagtaagccgaggtcacacccgattgcactccagcctgggcaaaaagagggaaactccacctcaaaaaaaaaaaaaaagaaaaagaatgcttggctgggcacagtggctcatgcctgtaatccctgcactttgggagtccgaggcaggtggatcacctgaggtcaggagttcgagaccagcctggccaatatggtgaaaccccatctctactaaaaatacaaaaatttgctgtgtgtgatggcacgtgcctgtaatcccagctacttgggaggctcaggcaggagaatcacttgaacccagaaggcagagtttgcagtgagcagagattgcgccactgcactgcagcctgggcaacagagcaagactcgggctaaaaaaaaaagctgaagtgagtccttcaggctaaaatgaaaagatacaagataataactcagagctatatgaaaaaataaaaatcactggtaaaggcaactatatagctaaatataaaagctagtattattgtattttgggtatgttattcctctttctcctttatgatttaaaaacatgcatgaaataatatgcatctatgttaataggaactaattgtttaaagacataatttgtaacaatatagctaggggacagagaaaggagcagagttaatgtatgctattgaagctgagttggtatcagtctgaactagacttagaactcagcatgttaactgaaatcttcatagtatccactaaaaacaaaactttaaaaatatacagaaaaggaactaagaaaggatcaaaatattacaggataaatcattaaccaaacacaaaagaaggtactgaggagcaaaacactttatgtagaaactaaacagcaggatgacataagtaagttctttggtgtgtgggtttttctgtttttcttttttggggtttctttgagacagagtcttgctctgtaactcaggctggagtgcagtgtttcattctcagctcactgcagcctttgcctcccaggttcaagtgattctcagcctcctgagtagctgggattgcaggcgcccaccaccagacccagctaattttttgtatttttagtagagatgaggtttcactacattggccaggctagtctcgagctcctggcctctagtgatccacccgcctcggcctcccaaagtgctgggtacagccatgagccactgcatccagcctgtttttggttttttttgagacagggtctggctctgttgcccaggctggagtgcagtggcacaatcacggctcactacaaccttgacctccgcaggctcagctgatcctcccacctcagcctcctgagtagctggaactacaggtgtgcaccaccatgcccagcttatttttctattttttgtagagacaggagtcttgctatgtcgcccagcctggtctcaaactcctgggctcaagcaatctgcccacctcagcatcccaaagtgataggattacaggcgtgagtccaaccataagtaagtttctgttttttgtttttgagtcaatctcactctgtcccccaggctgaagagcagtggtgcgatcatggctcactgcagcctcacctccaggcgggagccaccgtgcccggtcaagtaacttttctgtttcagtaatcactttcaatgtaaataatctcatcaatggaaagatcggcagaatcaatttttttaataatgtaatacataatccaaatatgcaactcacaaaatactcactgtagacccaaagacacaaatttgttgaaactgaaaagatggaaagagataatccatgcaaatagtaaccaaaagagagccagggtggctatactaataataccacacaaaatagattttaagccaaaaactgttacagaaaaacattttatgttcgtaagagagtcaaatcacaagaagatgtaacaattataaacacatatgaaccaaaaaaaaaaagggctccaaaatgcacaaagcaaactaataaaattgaaggaagaaacaattttacaatgatggagacctcaatgcagtggctctatcacagctcaccgcaatctctgcctcccagactcaagcaattctccagcctcagcctccccagtagctggaactataggcacacagcaccacacccagccaatttgtgtatttttttgtggagacggggtctcaccatattgcccaggctggtctcaaatgcccaagctcaagcaattcacccacctcagcctcccaaagtgctgggattacaggcctgacctactgcgcccagtcaacaccccaccttcaacagtaaatagaacatctagacaaaatcaataaggaactagaggaattgaacaacacactaaaccaactagacctaacagacatatagaaagctctccatctaacaagtgcagaatatatattcctctcaagtgcatatggaacattccccatgataaatcatatgttaggtcacaaaacaattctcaatacattttaaaaggtcaaaattatatgaagggccacatgtgttggctcacagctgtaatcccagcacttagtgaggctgagacaggcggatcacttgaccccagaagttcaagaccaggctgggcaacatggtaaaaccctgtctctacgaaaaaaaaattttaaaattagctgggtgtagtggtggtgaatacctgtagccccagctactcaggaggctgaggcaggaggatggcttcagcttgggaggcagaggctgcagtgacccgagatcataccactacactccagcctgcaggacagagcaggacctgtctcaaaaaaaaaaacaaaaaaaaaaaaacaaaaacaaaacaaacaaaaaaaaacaggccaggcttggtggctcatgcctgtaatcccagcattttaggaggccgacgcaggtggatgacctgtggtcaggagctcaagaccagcctgaccaacatggcaaaaccccatctctactaaaaatacaaaaaattagctggaaggggaggcaggcacctgtaaccccagctacttgggaggctgagccaggataatctcttgaatctgggagacagaggtttcagtgaggcgagatcacgccactgcactcaaccttgagcaacagagtgaggctctgtctcaaaacaaacaaacaaaaaaattatacaaaaaaaaaaagtgaactgcatgttgctgcacagtctaccatagcacaaatgtcaattgcttcttggctttcctggggtgatgggaggtctgaacctaacacagtctcacctgatccttcacaggagtcacgtagcctttctctctccagtccacagatgtggggatctcaagaagcaggcgttcctggaactgtttccccttcctgtgcttctggtattgaaaaccattcatcacctgcctgaattcttcagtggtcttcaaagaaaagtaaataaaatgttaagaagcaagagattaatttggtaaagaactgaggaggggaagcacagagctgggcagcccacagcatacttaccatgtctccaaaggcgttcatggccattgtgaagctgtgtttcccttggctgtattcctgattgtgctgctcagtcatcttcatgttctctcacactgctctcctccatccttcttcattctaaaggcaaacatgtaactgatgttcttcatttctttttttttttgagacggagtctcgctctgtcacccaggctggagtgcagtggcacgatctcagctcactgcaagctctgcctcctgggttcatgccattctcctgccccagtctcccgagtagctggaactacaggcgcctgccaccatgctaactttttgtatttttttttagtagagacggggtttcaccgtgttagccaggatggtctcaatctcctgactttgtgatccgcctgcctcggcctcccaaagtgctggtattacaggcgtgagccaccgtgccctgccgatgctatttatttctaattaaaacccaacatgtgctaaccaagtgaatcttcagacagagatgtaagagtaaccatggccagggaaggcttgacacttctaggagatgttttccaagctgagacacaacaagggtgtatgcccatatcgtgctcataatcagtgctattaagttattgcgttagcttattggtaggagccagcctctagaagccactctctggccatatgatcccaatagcaatgcccatctctctggggttcccctggacagtttcagatgccaccaaccatgtcatataatctcttgtgctttgccttccacttggtccattgtgcgtctaaactgtggtcacgtgttagagcagctgaggcaattcccaggcaaaaggcagccaggaggagtgaaggattcatgtttcaaaaatctaggaagggaaaagaaatgaggatctgattagaccgatcctaaaaagccattttactaccccctgagaaactagggccaccatggtagaataaaaatatttaaattattcttccaagcatttacctaaggactgtggaagaggccaaggatgtggctggagaaaaacagggcaagtggaggtattggagggacccaccaaaatgaaaagcagcctgtccagagctgtaggagttgaaacagttttctgggatgatgatgacaggctatgaaaaggacaggaaggtacctgatgggcgagaagcttaaggcaacaaccgggaaactaggaaaccgttggcccaggttttgtaccaattgtgctgaggtcatccaggcaaaacctcaagaatgaagacatctaatttcaagaagggacaaagggatccccaataattgggaagtcacatcacaccttgttcttggctaatacacaacagaaggtgaagtatgttttccaaatgccccttgtaatgaaacagttattgaatgtcttcccaggacaaactgggaaggagagcacccatctaccgccgttcccgcagtcctgcagtcctgcaggtgggccagtcctgccaacactccagctcccctcacagagcataaactgaatcaggtggccgaaccaccggaagccagagtccccagtgtccgcgcccacacaggggtgggtaggcagcttcccaggctttgggctggggacccaggccaggtctcctggctcttgctcccgccctccgctcatgctcactgtggccccaggacgtgggcgatgttgcagggagcaaggggcgcctctgcctgatttgccggggtcgagcctccctgtcccacccccaccggccctgggaatactgcggcctggcactccggaaaatccctcactcacagagctgaaggacttgctgggtccctggtggcccctgtccaatcttagcccactggggtctcagctgctgtagccacaggtggacaggcacagtgggcaggtgctgggtccaggagtctcctgtcgcctaaggccgcccgaaagcagctaattgacctctaaagcccctagacgcccctgcccccttgccgcccaggcaggcccgcccccaccacttgcccgctctgcgattggctgcgccagccgctgggcggggccttccggcgtgctgactcctggcatgtggagcagctcagtccccttgcctcagtggaaccgggggaggggagctgggggctacgaagagaagggtcggaggtctccctggagggttcggatcaactaagtaccctatttaatgccctgggcgggtggtttatgaaaagaaatttacaggagccctgtgtgcattttcagtttaaccctgcttttcccttaggcctagaatttttgattaaaatctcctgcagggcagagagccagaggactctaatccagtggttcctgtttagtccacagcaaaggtgcggctggctggaagaacgcacagcctgcaagcagaagccttacctcccaattaagggtgtagaagaatctgggcgtgttgctggtggctcatgcctgtaatcccagcactttgggaggctgaggcaggcagatcccttgagcccagtagttcgagaacagcgtgggcaccctggcgaaaccccttctctactaaaaatacaaaaattagccgagtgtggtggcccgcgcctgtggtcccagctagtcgggaggctgaggcaccagcatcgcccagcccggaaggttgaggctatagtgagccgagatcgcaccactgcactccagcctgggcgaaaggagaccctgtctcaaagacaaaaaaacaactggtaggaaaacgcaccctcaaaacacatgatgagatggtcgagaccagaccctaggagggtgggtactggctgggtgggtatccagagaccatgggcgtttcataatgcattgtttcccatctcctccactcagcgactcttcttcccctgaagtcttgcattaagtaagtgaatgaatcaatcatcaagttaatgaagctctgactttgtacttgttgtcctttgcttggtacagttgggcactgccttagaaacaatctccaggtaattttcccaactgcttttgtgaggcccagttttccattttaaaatctaagattacctcagtaatcttgcttttacagcaaatgggcatggagcctgacagatatatttaaactaagttatggacaagctgcctggtgcattaggtagcataggagctaaccttgtgggacatctccccatattcgtaatattcacccctacatctataatcaataaatgcttgtttggaggccatagaaactcttcctgagatctgacctgtgtcttctgctatctgcctgatttctccccatagaacaggaaaacactgtgtaggagatattgtgaatagaaatatgaatataggccgggagtggtggctcacacctgtaatcccagcactttgggaggccaaggcgggtggatcacctgaggtcaggagtttgagaccagcctggccaacatggcgaaaccccgtctctactaaaaatacaaaaattagccacgcatggtggcaggcacctgtaatgctagctactcaggaggctgaggtaggagaattgcttgaacccagggaggcagaagttgcagtgagtgagatggcaccactgcactccagcctgggcaacagagtgagactctgtctcaaaaaaaaaaaaaaaataaattacaaaaattagccaggcatggtggtgggcgcctgtaatcccagctactcaggagcctgaggcagggacaacggctcaaacctgggaggcagaggttgcagtgaaccgagattgcaccactgcactccagcctgagagacatagcgagactccatctcaaaaaaaaaaaaaaaaagaatataaataggaaatacagtgattcaaataagcaattgttagttcctcagatcagaactgtgagttctatactagactcttacatgttatttcttctggtatcttagcaatgattctgaataaagatcagactccttagtcggcaggtgggacagttctcaataacagaagctgggttctcaggggatcccgtggatatgaggatgaaggttagaagcacttgggaccatacctgcaggtctgatttgaggacaatgagaccaagacaggaaggcagcacctgctgaggggctgggggtgggagaagggaggaaacgggacacaagaaaataagtataaaccaccagactgcagtcagtgatcaacaaaattcccaagtttatattgagaagatttccctggtttggggttttgaagagattatataagggattcgggttgcttgatttttttcattctttttcttttaacttggtctcaatttttttgtaaaaaaaaaaaaaaagaatgtcttatgtgcgcctttagaactggtgaatgaatgaacctccctttttaaataactgagattgtcactgaagcactgtcatccgatttaggcttaaaaatctgacactgaatttatcctagatgataaagtgcaagtctcttgtctcctagaaatgatcaggcaaggaaacacccaggaggcccagggcaaaatgccctcctggaagctggtggggtaggaagatgctgaggcccagtatggtccctggagcatgcattctgtgtggtgacagaaattgtttgcttgaccgtacattggtcaggcttctgaaccttctgctaaacccatctgtgcactttttgtaaaattcagttttaggaaattaccctgctaagtcagtttagctggcaggaatccccgtccaccatatactgatcagggtcctcatcccccaccatcccgcagctgatgtcagataaccttggcctgtgctcagcgagaatctcgttaggtcagtttagccagaatcctcccttacccttcatgttccctcatagtcatttcctatctgctaacccccatcctcctccttgagtataattaccacttccttgtgctggattcagagttgagcacaattgctctctctcactgtaagaactacttgcagtgctcctagacctacatatgtgaacctgtttctttaacagtgactcacctgtctttttctcctttcaacttgacactagctgaggcttatccgcatcaaagtggagggactggccccgggggatcctcagggcttcaccttgatggcctgcaggctcacattccactttttctggtgccttctggctccgagtccagtttgccacacaagtgatggaggttggaaggagggatgaggtgacagaggtgaaggagggtaaattcttttctaagccctacttgcctgacatgcatttaggtttttagaaaggaacctgaccccaccctttattttctatctcccacttccatgactagccttacctgtaaaaatggggcatagaagagcccccatctcctagggcagtgtttttgagcagggggtcactgaacagtagcaccttcatctcttgggaccttgttaggaaattctggacttggggtggttgatcatgcctgtaattccagcactttgggaggccgaggctggcagaacacgaggtcaagagatcaagaccatcctggtcaacatggtgaaatcccgtctctactaaaaatacaaaaattagctgggcacggtggtgtgtgcctgtagtcccagctaatggggggctgaggcaggggaatcacttgaacctgggaggcagaggttgcagtgaaccaagatcatgccattgcactccaacctgggtgacagaggaagactctgtctcaaaaaaaaaaaataaataaaaattcctggaaatggattagcttgctgacaagagttattccattgtgtgtttctacctgcaatacctgaggatgcccattttctcacgatttataaactaactcattttatagatgtaattttcatacatttgggggtatcgttctaacttcattattattacttcaaggtgttattatttccccatcatcatcatggtcattatcataactagttggtgctgacagtagtcaccctgcattgagaactcatgctccaggccctttccacatagacttgatttaattccattcactcctcacaacaatcgtctgaaagaaagaatcactaagccattgtataattgaaacacaagaggcgagtgacttgtgtgcccttgggcaggtaatttaaacactctgtgcccccaagttccaatagataaatgtaaataataatatctttcttacctaatacatggggtcaacagttaaagtactgtacatttgtgaggtatttcatggcacctgtgaattgctcatgtgatgacttagtgtgcttccagtgtcagtgtgctgggaaggagacagaataagaagaagactgaaaagatgccgagtctagtgcagggtatcctggggaaaacacctcctgtttgtccaacagcgattggccacacattgaagacacactacctggctgtgaactggggtgaccctgttgaaatcttgtggaaagcttgagatgctccttagagggtgtttatccctcgagctggcacaaatgcggtttgttgttcagtttttccttctactctgcctctatctggtacaaaatggaattgaagaggatataaaccagcaaggaacaatctgaaatcagaatggtgacaatgggagaaagtaatcttggttcaacccaatgttcacctgaagtctctttattaaagactactaacaggaacgaaattgcataataatcttcctatgataatttcaagttccagaatttctctatggaactttcaaatttcacctctgttaactcatggaattttccctagaatctgcaaattaccgaagtctttggaggtttgatgatcactcactggtcagcggtactacaaaaggattctggggagtttgactcagtggtcagcaaaggctcttccgaatcttcagtctgattctgagattccccggggagaactggagcctttcttaacagctgttgattggaaagaccacctgcttcatcctctattgcaacagaaatagccattgtgaatctccatggggaggcacaatgagttttttctagcatgtgtgactcaggtcattttgttccgtggtttccagttgtggggacttggcaaggtcacaccctcccctgagcctcagtttcatcgctcagaaaatgaggataacaattctacttgcctcataggattgttgtgaagattaaatgagacatgtaaacatttgcttatagtaatttcacaccactttattgtggaatcaaagacagaattcttacagaggtcttggttagttaagaaaacatccattcaaagatttgattcacaggacaccctcactgtctttctctcttttttttttttttttttttttttttttgagacagggtctcacttcattgcccaggctggaatgcagtggtgtgatctcagctcactgcaacctctgcctcccaggctcaagagattctcccacctcagcctccgagtagctgggattacagccatgcactgccactcctgggtaatttttgtatattttgtagagacggggttttgtcatggtgcccaggttggtcttgaactcctgggttcaagcaatccacccgcctcagccacccaaagtactgggattacaggcgtgagtcaccacacctggcccttgcttactttcgtacttcccaagaggcaggttaccaaattggtgaaattaaccataacatcattgtgatgggcaagcagatatattaaaagcaaagatacagcaggttaacattaaattttgctcatcccaggacaaacctggccacaggaggcctttgccagtattctgaaaagtgttgtgaccatctcctttaaagctcagttaaaggtttctggctggactccaggctgcttcaagctctttacttgtctttatcattctttaaggagggacccagacacagtatgcagaggcctgaatcctctagatcattctctctccaccatgagtcctgccgtggggacttttccagctccctttggccttatgagccagaaaatcaggctagagcctaaagagaacagaaatttcagaatcaggcttgttctgcgactgtatgggggagctgaaggacacaatgggctttctatattggagactacccatcatactctctctgcccagggagaaaggacagatgctgtgtgattttgcagtctgtgatttggcttctcattctcgctgctctctacacctcattgtttacttcactcccctgaaaaaaatgctccctaacaggctcagtacccaacttctgggtattgctgcccacatttgccttggttctaccttttcagattgcaggatcctgaggttttgcttggagcagctcagattctccactagatctaagatctcacctagtcctgaggatttccttaaagggaaggggaaagatagatagatagatagatagatagatagatagatagatagatagatagatagatagatagttgctgcctttgctctacagcatctgcttggtgaagaggctcaggatctggatcctggcctctcagctctcaggaaccccattcccccctgacaggggtggcaagttcatcctattattcattaagaaatttgaaaacaatcattcaggaattttaggtcaagagctggaaaaccccaagcctccatcacctgagcaaagggagatactgtgagcacctgcaggatacacccatgttccaccacctgcctgaagaagcctgtggttcttgtcagcttctcaagggtgaagtgcagatccttttctgcttgagcagaagagcagaccaaagagctcattgactcaaggagcatcacggcaactgagctgcacctggaagagaagaatccagggtgtgatccacagccaaggcctgaagcaatggggcccatacttggcctctccagggtgagttgtgacccaagtgctgggctttagcccatgagtggtccctcttgccatttccagtttcctcccaaagagaggccagtgttggtgatttcatttcttataatctccttaggagcacaggttttggtttgtgccttttttggatcaggttccctgcattgcagctgctataattaaaactattaacaacaacacagcaccacagaagcaagttagttgctaatggaatttgctgataatgctgtcttctagagaccactctagtaactggagagccttggtgtagagctgatgataaaacctattcctgcttttgtcagtcatgaggagcatttcctttctagacagaggaactgaaacccacatgccagcccaaatttaccaaaagcagtcactggaatactcatcacaccatcatgtctcatcttatccctttcgttaccttcaaatacggccccgtttcctcaggaccagaactcccttatgtgggcagcaggactaaggcccttgagttacctgtggtgactcctcattaaatggaggaatgtgccagtattttcagcaaaacatgaatctgatgaaacactgactgaactgtctcctagtttcaaaacaaattattaccactcagggcctctatttagggcaatcagagtcagaagtgggaacgcatcttgtcctcctaccttgattaacagtaactctaattgcaggatgatggtcaaatcctctctcctctaatgtgcagttgtgaaggatttaggctccactgctcatgcatttgggtggggcctgaatcactttcagtctagcacaggcgggtcacttcaggccttcccacctccatcagcatccttcaatcctcccctgacatctctcatttatgcttcctattgattcagaggtcccaacccgagtggctaaaagaaacattcattaacctttctacaaagtcatgaataatccatggattacattgaattcatccctactaaaaccatcttcagaaattcagatgtagtaaccttctttctgaatttttttttttttttttttttgagatggagtcttgctctgtcgcccaggctggagtgcagtggcatgatctcagctcactgcaagctccacctcccgggttcacgacattctcctgcctcagcctcccaagtagctgggactacaggcacccgccaccatgcccggctaattttttgtattttgtttagtagagacggggtttcactgtgttagccaggatgatctcgatctcctgacctcatgatccgcccacctcggcctcccaaagtgctgggattacaggcataagctaccgtgcccagccaagtattctatccttaatgaacacatatatgcacattatatctattttttataatatatatatttagaattgaatgtcagagtacatatcagtgttggaggaagagaataaggaggaagcacagaaagtaaaaaggaaaaataggcaccaaaaaagatttggagaatggcagatggccaaggagatgcagttgggaagtgcctcttccatggagaggaacccaaatatctagtaaaccttcacattttaaacagatcttttgagagaaaacactgaaagttgacacagaggtgacacagacaccatggttgaagagggaagaaatgggacagtctgctcagagtcactagacatcaggactggcccatataccctgaacaaacccaaggaaggggtgagtgaaggaaccctgggacactacatacccataatgtacctctgagatcctagttacaggagtttctacgaccctcatagatctttggactggtaggagagctgcctcgagcacatgcagaggcacagtttgaacccacacagagcccagaaggctttgttgtgctgtgcagctgcagcaaaatgcaaccctaggtgcccatccctcaagcctccatttcatactgagtggctaagttcctgctgtccgccaggctgggagtgaaccacgcctggcctgctcacatgcccaagataggccccatcaccagtgctgtgtgattaagttgcatctggtccacatgcccccttgcctgtcaaccccttcccagagctcatgcctggtcacgcctgcaagagggtgtccacagcacagcatccactgcatagcttgagtgttttgttgacagcctgggaaaagctcaccaccctgtccccaagtcacagccagtgcttgaagcttagaggccagaggacaaatccgtgagcccagtcccaactccccaagactcaagtataccacccagggacactgagctgagatttgtaacctaatctcaagtgaaggaggatcctccatagtcagaatgcagagaagggtgtggtatgggttctcatgggggcatgggaactggacacccctccctttgcaagaccagaccatgaagggtatggcctgatggtggtagcttctttcccagggagtgtcctggcacagaatgcctggagcagctcaacaatgtgggagcagatggcttggggaaagcctagttggttgggcttgccgccagggcgagtgtctgtgggagatctgctgggtcaggggagtgtaagctaggcagactccatggttgcctgctgggctgaaaatcatgggctgcagactccatactggtgttgcacccattgtgccactgccctgcctggagatcctctacccttgaaatactgcatcatcagagcaactgcagacataccctaaaacctgctctgactttggtaagcacagtggactggtgggtctctggagagttgtgtgtccctagagatgtaatcctcagtgtggaccatccctaagggaagggggagtgcagcctgccaaagcacaacatgagacaaagaaaatgcggccatggcataagccactgaaaggagcaccaccaaggcccagaaccagacttggagaaggaattatgtctcgcctccatctcccctccccagtgcactgttgcagatgcaacaatagctcttcccataggggcccagaaagcgtgcactgaaagaagttgtttctcatgattctccagtgagggcaagcatgcaccaagaccccacctgccagctcttactcttaagtccatctaccagactgaagtttgagttataccatcatataaaaatacattgctaaaacaagcaacatctgtgaaagccactgcagcaacctatctgtaaccaaggaacatatatggaaacttcaccctctgcaactacagagaaatgaagccaatcaatcacatacaccactgtcatactttcaaagagaataaaaaatataaaagccctgtgatggttaatactgagtgtcaacttgattgtattaaagggtgcaaaatattgttcccgggtgtgtttggagggtgttgccaaaggagattaacatttgagtctggactaggagaggcagaaccaccctcaatctgggtgggcaccatctaatcagctgccagcacggctaggacaaagcaggcaggagaaggcagaagagcagacttgctgagtctcctggctttcatctttatcctgtgctggatgcttccagttcttcagcttttggactcttggacttacaccagtggtttgccaggggctctcaggccttcagccacagactgaaggctgcactgtcagcttccctacttttgaggttttgggactcggactggcttccctgctcctcagcttgcagatggtttattgtgggactttaccttgtgatcgtgtgagtcaatgatccttaataaactccccttcaaatgtacatctatcctattacttcggtacctatagagaactctgactaatacaaaccccatctaaatgaagcaaattcaaaaaagaagtgtcaactcccgcagatggaaaggaataagcacaagaagtctggcaatacacaaagccagagtgttttgtgatctccaaagcctctcactagctccctaggaaaggatcctgaccagatgtaaatgtctgaaatgagacacatagaactcagaagatggatgtcaatgaaagtcaatgagacataagacaaaatagaaatccaatgcaaagaaaccagaaaaacagtccaagatttgaaagacaacatagttatattaagaaagagccaaactgaacttctggaactgaaaaattcactaaataaatttcaaaatatagttgggagacttaaaaacagactaggccaagcagaaggaaacacttcaaagcttgaagactgattcttcaaattaacccagtcatgcaaaaataaagaaaaaatattttttaaaaagacaaagccttcaagaaatatgggattatgtaaagaaaccacttctacaacttattggtattcctgagagaaaagaaagagtaaccaacttggaaaacatatctgaggaaaaaattcaagaaaatattctcaattttgctagagatgttgacatgcatacaccagaaatccagagaacctctgttatacactataaagacagccatccccaagacacatagtcgttagactatccaaggttaacacaaaagaaaaaacaaatctcagacacagctagagaaaagagcaacactacctacaaagggaacccatcagactaacagtggacttctcagaagaaaccttacaatccagcagagattagaggtctatttttagtactctaaaaggaatgacattccagcataaacattcatattcttcaaaactaagcttcataaacgaaggagaaattgagtctttctgagtcaagcaatcggtaagggaatttatcaccactagactagccctgcagaaatgcttaagggagttctaaatgtggacatgaaagaacaatacacagaaaaagcacagttaagtacatagtccacagactctataaagcaactacacaattgagactgcaaagaaactagctaacaaaactatgacaggaacacaatctcacatatcaatgttaaccttgaacataaatggcctaaatcctccgcttaaaagacatacagtggcgaattggaataaaaaaatcagaatcacccatctgctgtcttcaagagacccatctcacaactaatgacactcatgggttcaaagtaaagggatagagaaagattaatcatgcaaatggaaaacataaaagagcaggagtttctattctcatatcagagaaaacagatcttcagccaaaaacagaaacaaggacaaaattgttattgcttaatgacaaagggctcaattcaataagaataattaactatcttaaataaatatgcacccaatattaattggagcatcacgatacataaagaaatcactactagacctaagaggtagacagcccctcagtaataactgggaacttcaacactccactgacagtggtagatagattattgaggcagaaatctaaacaaataaattctggacttaaatttgccacttgaccaattgaacctaatagacatctacagaatactctacccaacaaccacaatatatatatttttttctcatcttcacatggaacatactctaagagtgatcacatatgcagttataaagcaagtgtcaagaaataaaaacaatcaaataatatcaagcatcttcttggaccgcagtagaataaaaataaaaatcaatagcaagaggaactctaaaacacagacactcacacacaaacacacacggaaactaaagaaattactcttgaatgacttttgtttgggtaaacaataaaattaaagcagaaatcaaagaattttttaaacaaatgaaaatagagacacaatgaacaaaaacctctgggatgcaataatagcagtttaaaaaggaaagattatagtgctaaatacctacatcaaaaagatagaaatatctcaaattaacaatctaacattgcacccagagcaagtagtaaaacaagaaaaaaaactacatccaaatatagcataagaaaagaaataacaaaaataagaacaggactgaataaaatcgagactcaaaaatccacacaaaggatcaacaaaatgaaaagttggttctttgaaagtgtaaccaaaattgatagactgcaagcaagattaacaaaaaagaaaagatccaaataagcacaatcagcaataacaaaggcgacattcaatcgagtcccacggagattcaaaagattctcagagactactatgaacatttctatgtgcacaactagataacctagaagaaatgaatacgttcctggaaacacacaacttcccaagattgaaccaggaagaacctgaaacactgaacagaccaacaatgaattacagaatgaattgaataagtaatagaagcctaggactagatgaattcatagctgaattctaccagacatacaaaggggagctcatgccaatcctactgaaactattccaaaaaatcgaggatgagagattctcctctaacttactctacaaaacctatatcatcctgataccaaaatatggcaaatactcacacaaaaaacaaaaccctaggccaatatatctgatgaacatagatgaaaaaatcctcaacaaagtacttgcaaaccacattcagcagcacatcaaaaagataatacaatatcaagtgaactttatacctgggatgtaagagttgttcaaatatatgcaaatcagttaatgtgattcaccacataaacagaatttaaaatgaaaaaaaacataagattatctcaacagatgcaggtaaaacatttgataaaatccaacatgccttcataattaaaaccctcaatagactaggcattcaaagaacatacctaaaataataagaaccatctattgacaaacctagtctacgttatactaaacaggcaaaagttggaagaattcccataagaataagaacaagacaagaatatccactttcaccactcttattcaacttaatactggaagccctagccagaatgatcagacaaaagcaagaaacaaaaggcatccaaataggaaaagaggaaattaaattttatttcttcactgatgataggattctatacctagaaaaccctaatgattctgaccaaagactcctagagttgattaaaaatttcagtaaagttttaagataagaaatcaatatacaaaaagcagtagtatttctatacaatgcaatattcaaactgagaaccaaatcaagaacacaatcccatttacaagagccacaggaaaaaaaaaaaaaaagaaatacttaggaatacctctatccaaggaggtaaaagatctctttaagtagaactacaaaacactgctgaatgaaatcatagatgacacaaacaaatggaaaaatattacatgcttatggattggaagaatcaacatcattaaaatgtctttactgcccaaagcaatctacaaattcaatgcagttcctatcaaactgccaaagttatttttacacagaattagaaaatcaattctaaaatttgtatttaactaaaaaagagcctgaatagccaaagcaatcttaagctaaaagaacaaaggcaggggcaacacattacctgacttcaaactatactacaaggctacaataaccaaaatagcatggtttgggtacaaaaacagacacatagaccaatggaacaaaatagagaatccagaaatgaagtcccatacctacaaccaactgatctttaacaaaattgataaaaatacaatggggcaaggataccctattcaattaatggtgctgggaaaactggctaaccatattcagaagaatgaaattagactcctgtctctcaccatataaaaaaattaactcaagattgattaaagacttaaatgtaaaactttagactataagaagcctagaattagacctaagaagctcttttggatattggcctatgcaaagaatttatgactaagtactaaaacacaaaagcaacaaaaacaaaagttgacaagtgagaccaaattaaactaaagagcttctgcacacttgcatgttatattgcaaatatgaaatagcaaagacatggaatcaacattggtttccaacaatggtggattggataaagaaactatgatgcatatacaccatggaatactatgtagccagaagaaagaatgaaatcctttcctttgcagtaacatagatgtgcctggatgccatcatcctaaatgaattaagatgtaaacagaaaaccaaatactgcatgtcctcacttataggtgagagctaaactttgggtacacaggagcaaaaggatggaaataacagacactggggactccaaaacaggggaaggaaggaaggcaaggtttgaaaagctacttattgggtactatgtttactattcagataatatgttcaatagaagcccaaacctcagcatcatgcaatatattcatgtaacaaatgtacacatgcatgcttaatctaaaataaatattaaataatcaaataaaatgatttccatgaataaaacggtagatatgattatgtggaaaatgctttactatttattatgtggtgaataatttaataatatttaataaatacatgaatgaaaaatagctacaactgtgtgttaggatttcaataattttttatttcattcctataacttttatgtattattatatacataataatatatagttaataataacaaaaacaacatggtattgaaataatttccacccagaaggaggatcaacatatttaagtgactacactactcgagataaaaatcatttatcaaacagatcaaagtcatttacctgctttcctttttataggtcctaggaacacacgtgccatagacaataaaacatcacttcccccatcccactaccttggactttatttaacatctttgggtagaacagaaactgttgataaggtgagttttgttttatagacaagagaggaaaatggatactttttgtggtctgggccttagaaacagactaagatcttttttttttcttttttgctttttttactagcataaaatattaattggcaaaacaccgaatacaagcttcactatcataaaatcaaaacatttaagcaatattccaaaaaagatttgacaaaaactagtcaccaagagtacaaaaattacacatcaacacaaagcataaaaaatgtgaactttcaaattaaacagtcaaaaacatgtacctgcgtgatcacctccacaccttgactgccttcgtctgcagcacgctgctggtaaaggctgggtggctgcaccgtcgtcccctaacccaacattgctttcatctgggaaaattcgcttgatagccaattaagccatggaggctattacatttacacggggctacgcacaatctcaggggacgctcaaacagcagttcgttcctcacacgcactgttgggtgcaaagggcacctggagagtgagggagacctgggcgctttcctgcggggccttggccacgcggccgtcgcccgcaccctgtcccttgcctggcaggggacacaatatttgtacagattatggtataatttgaatgattttctaatctacttatcttaatttatatagtttatttaaatgtcaaggcagagaaatacattgatcatgttaaggtcacgtgatgtggtggcgcagtaatgacttcctgaggaaacagaaatcggatgttttgtgatttagctatgtgcactaaacttattttccatgttttgagagcacattaaacattcacgtacaatgtgggaataggctggctcgtaaccaaaacgtccaacccaatgccaccctttgaatcgctgtgaacaccgtcctattgcggttcagagaaaacaagcaaggctgcgaagccccggggttcaggcagctgcagcgcttgggccaaggtagctccgctctctggtctgaagccacgtggccccaccccggggcggcctggcttttttatagtgcttattgctgtgtttggcatgccattcaacccatcgggatgttggatagtgacttgagagcaatccctagatttgccctgtcgggatgttgcatactgagttcggaataagccctgctcaactgaggcactatcactaggaggaggcactgattcccgcctttcaatgctatctattggtgaaagaggagttggatggcatctgggaaattagtatcacttctactttttcttcttttcttttaaaggttaaaaataccttgtattagttaatactgctataaaatatgaatatccaaatctctgtggctcagtaaaatagatttttttttcactcagagaaagttcaggttcacccttagtaacccaggctgacagagactcttccattttctatacatagcttccccaattgcccagagaagagtggaaagatttgataggtgactgtacacaagaataagaacttagtacctagtcactaatttactcgttgaataaacatttatggagcttaacatattaatcactgggcagacgctgggacacaagaaaaatctttaagatatgtcactgcttattaccaataatgttctagtgagtaacaagagttaataacacgactaattatagtattgtaaatataattacagttccaataagacatacacacacacagaacgattttgtctggttgttgaggaaatctttattgatttaagatatcttttgatgaacaggatttttcaataactatcagaaaaagaatgtctatgacttatttttaaaaactattttcttatctgccttgcatatctgacactttcatctcctatcttccttgaatacaatatagaacctgacatttctttcctttcaaagatccttagagcatttcctacatttaatctgaatgtctttctcagtaatttttcccatacaagcaattatggctacattttcttaatataatcatgaaaaggtgagcaaaactgaaaatttaatttggagaatagatacgaaacattcaattaattcaagttgttgttaggctgcatatgttcagctttcagtgaagatgaacaaatgatgataaatgagaaactgaaagaaaacaaaccaataggtgttttttaagaaacaatattattaaagtgcatgtgttttctactgaatgaaagcaacatagaccttttcctcacattggtagttagtaagatgtataaaaacaactttgtaaagaacaattaatacaggttaatgaatcattgtgaaaaggggataacacactttattgtagcaatgatctgcaaggtgttaaatgttaaaaaagatgaagaacaattgagtagttatttgatcacagtgtttattaaattgcttttcctgtatctggcaagctttacagaaatgtcttcaacagaataactgtgttaaaagccaaatgaaatgcattttgaaatatgattcttcacttggtgtgcaggtataatctcaggtgtaattcagacaagagacaaattcaattttaaagttccatttgttacaatttgatgattgtgattaaagaaccataaaaattttatctttgacatttcattttttcctcacaaaagtattctactgcaattttcttagttttctttcctcttaactgtggtgttacctataaatgctggatttctctgttttacgtgcaacaaatctacaatcaactatttctggaacgccacttcattttaacaacaaggacccataaatattttaaaaattcaaaatgttatatataaaatgttaaatgatacacataatacatttctaagtagtaattatgattatgcccataattatacccataatttaaaaatatgttacctgaagtaaattattatacgttttatgttggaagtgttcatttatctttgatctctgttaacacattgtactatgtggtaataatataaactgccttactggatagtgatgtatctttggtttcatattgttactggactaatattccaacactatagatagtgaaatttaacattgaaacaatttgataatgccatcaatgaatccagtttttaagagtgggatccattttctaaaattgagtatatagatacttcatgagatatcttatcatgcatcctaaaccaaaccaacctcttcccctgactgtcttacagtgtattattattattttatccaccacagcaactagtacatttttcagaacctagtagatattcagtcattgtctatggaatacatgaacacattctgaatttggacagtcatcattcttggtgttttaaaacaaacacttcctgaattgcatccactattttctaagaagccctaggaattcattgaaggagggtatgggtaagttgtgggtgaaactgtaaagatgtaggtcctcctcccaaaacttcttcagcgtatcttcattgctgtttgtttgcttgcttgcttgcttattttaaaagagatctagatatagtctaataagaattgtataaatgtgatgttccacaatgattctaacttacatggtgcaaaataataaaatattacattctacctgtttgtagaaaaccatggatactataaaggatctagattttctctctcctttccttctaagatttattcactcagcaaagacttacctggtgactacttagtgctagacactgttttagatacttgggctataacagtgaaaagaacagtaattgaattaatgaaaagttcattttaattagctgtatggtaaaataggaaactaacaaaaataaaatataacatgtcaaatggcaatgactgctctgagaaaaataaaggagaataagaggttctaaattattatatacggccaatattaccaacatattatagaaagaaatgagttcataatgtttatcagagaattccatgaaaatcgctaaatttttctagaaagccaggcactgataagagaataaacaaacagataactgattttaatttgatcttctcttacaggtgcagctatgatctgccattgtatataatataaaattaaaaattgtttatatttcattcacgttagcatataatgttcttacttttttttttttttgagacggagtcttgctctgtcacctaggttgaagcacagtggcacggtctcagctcactacaacctccacttcccgggttcaagtgattctcctgctccagcctcccaagtagctgggactacaggcaggcaccaccaagcctggctaatttttgtattttattagagacggggtttcaccaaattggccaggctggttttgaactcctgacctcagatgatctgcctgtgcctcggactccaatagtgctgggattacaggcgtgagccacagtgcccggccaacgtttttacatttaaatatcagacatctatcatattcctttctccctactacaaacattgtatgcttttcaataggcataagattttgttttcactcaggttggattcaacaggtattatttagcagttcattgcatctatccatttacccaatagaggaagtatacaagatacaaatgaataaagtgtaataattcttatactatttgcccttatgtcatgtaactgctccatgtttgtattccgaaaacctaactgggagggaaaactcagaaaaatagaataaaaagtattatatatctcatacatcctcatttttgaatattctaggggtacagatcagtataaataaaatactctggtaagtgaccaccacatcatctgtttgtcattcttagacccagagtataccattcttttaagaaagaaaacttgctactgtacctgctacccagtaacatatatatcacatatcatatatatatcataacatatatatcatatatcatatatacacatatcatatatctcatatatataacatatttgctactggttaggagtaacactcagaaaattatacttaataatgtagtacaattaggtataaattcacttagtatttttaaattttacgtatattcctatttatatgaatcgtcatttaaaatcacatctactgatcctgatagcattaaaggcataagaggtactgaggatattaatttaattttgtttacagctatgcacagatatttttagttcactgagatttaatccagtagtctattatttgattaattgtacagctatcaaatcattcaggactcccactgtttcaacaacgagagtggaaaaatattttttcatttatgtttatatgcagctatttgtagtctaaattaatatcctagcaattgatggtgaaattaaaattatttctgtcagatgtggtactttgatgacagtggataagcatgggaataaaagaaagttttgaggaagaggggacagtttttgtttacttaatgattattccaaagatgttaagtaaacattctatagaatgcaacatatagtggaatacagcattgaaacaatttaataatgtagtcaatgaatccagtttttagaaatgggatccattttctaaaactgagcatacagatacttcatgagatgctttatcactcatcctaaaccaaaccaactccttcccttgactgtcttgcagtgcatagggcatctctacactctaggaaaggaattatcaatctgtttatatgccacttataaaatcatacttaatgtacgattaggcataaatttacttgcatttttaaattttgtaaaatgttaacggaaagtgttcttgaaaaacatttctgagaattccaaaaaatgaacaaattttaatacataagggacaatatctttctagtgaattgattatcagagtgtaatgtggtatgttctgattatgttacataatattctgattagcagaaaattttgaataagtgaatttagcaaaatgtttagaggtcaagaaaactgttttagactgactatgttttctgacccaaatgtaagaaagaacccaataaaaagaggcagccagataatgctgttgtttgcaaacttaaacagaagcttgcatgtaatttatgactcaaagaaaaataaaaatagaagttatactttatttagaacttaatgacagtgaaaaattgcacataaaaaggaagactgttgaatacagcaaaagctggaattatataagaaatataaacataaacacacaaaataagtgtaaattataatgaagtaaaaatatatcaaagagaaagaaggaagcagtacaataaaaaataaagttgattctttaaaaaccatagttaaatagacaaatttccagccagattgtttaccaagtaaagagaaaaagaaggagatagatcaaaagacacaagatgatgatgaaaagagggtcagcacttataaacatagtagaaatttaagccataatgagcacaagaaagcattatcaacttacttttgaatatataaaatagacacttaaaaaactgaacaaaaatgacttactagttttaaaagaaaaaaaaaacatcaaacatctatccttccaaaagtatagacttcaaaagtatagtcccagaagggtgaacataaaccacactttaagcaagaactctcagttataaccagatgggtgaacataaaccacactttaagcaagaactctcagttataaccagatgggtgaacataaaccacactttaagcaagaactctcagttataaccagatgggtgaacataaaccacactttaagcaagaactctcagttataaccacatgggtgaacataaaccacactttaagcaagaactctcagttataaccagatgggtgaacataaaccacactttaagcaagaactctcagttataaccagatgggtgaacataaaccacactttaagcaagaactctcagttataactgcttgcagttttagaggatcccagccacactcctgaaccagagcttggcactgggtattccctctggaacacccttttatttccttctctaagcaaagacatggaatcaacctaaatgcccatcagtggtctgctggataaagaaaatgtggtatataaacaccatggaatactatgcagacataaaaaaagaacaagatcttgttctttgcagggatgtggatgtagttagagaccattatccttagcaaactaacacaggaacagaagatcaaacactgcatgttctcactcataggtgggagctaaatgatgagaacacacggacacatagagtgggggacaacacacactggggccttttggagggtggagaattggaggagggagaagatacaaaagaataactagtggttactaggcttaatactggggtgatgaaataatctgtacaacaaaccaccatgatacaagtttacctatgtaatgaacctgcacttgtacccctgaacttaaaagttaaaaatgaatgaagcctgtcagaaccacccatttagcagtctaacattttgcctagtattcccaaatccctttgcctagccaacatttttcacagcactttttgtcttcaaactactggcctgaagcaatctggcttagctttctgagtagctggaattgcaggtgtaccagtgtgcccagccacagttttttcaagacctgtttaagacaacaggttagagaaaatcaagataatattttgagggggaagaaggtaaaatcaattaagacagggtgcacagagtacttgaatggtacagataatgtttatcctttgtactaaatggtgtgtatgtgggaattggttatattattttgactgtttgtagtcatattatatacatatgtgtataaataaaaataaaagaaaaaatataagctaaatttatagatatattaattttatttaaatataacaaagatttgccagtattcaaatgtctgcaatgattcttaaaatgcacagaacctgtgtttaggtacagtatcactgttcatccagccttcattcactcgaatctactcttacctaaaatttgtaccgtaagtaaattacattctgtatgacagaaagcaaattacaatattagaacaacattatggaaaattggcataacattgtacaatcatccattactttattatttatcattttgcaaatttttattatattagtaaaaaagtctaactgtacttaatagctaatacatatattatttgatatttttaaagaccattattaaaataataataatttgggggtgagaaggcctattgaaaaatgaccaacgtggaaatcataaataagtttgatgcaacaaatatttgtgagtcttatagttaaaaatgtaaaaattcattataaacaaagctaaaagacaataatatgcattgggaaatatttgcaacatttacttcaaaggtggatgtccttaagagaatttttacaaattaataaacatttaaaaaggtgaggagtggcaatagctatgagagacaatttacaaaaacataaaaaatatgaaaactgtttaatctgtaagtacatcaataaaaattttattattgtagttattttatctattaaattaggaaaggtcaatacaattggtaatcttccaagtaaatataggagagaaggtctttctcatacatttataagaatattattttgttagaatgcaattaaataaacacttggtaaaaatccatatcctttgtccaaacaatttaagttctagacctctagaatccacatgtacatatacatatatacatacatatacacacacacattcacacctatatattaacaactcaaatccaactccaactcttttgtaagtagtattttgtccaacaaataaatttatctcaaattcttcttgacttttctccattatagagccagcaattctacgtgtaactctacctctaattcctttatttgcatttatttctgctttcaaacccttatatgaggcaagtgggattaatttatttcattaccttaactagattcatcgctttactttgtcaaactctgattgatttgctcaactcaatcttatgtgttcaagaacttaatgtggattcctgttccaccttatgaaagtcttttccaaaaacttgctaaattcttgactcaagacattgcagtcagtaatgcatttctctcctcaaatacaatggaactgtgttctaataaatactcttcaacaatgtgcagttatttctccacaactatcaattccccttaaagcagaattttactaaaaatggctttatccttctggggataatcagtaaaatggcaattggtgggtgaattaaaaatatactaaaagcagatggcagaacatgagtgcagatttttactacaaagcttaggaaaagcaaaaggaacttgaatagagaaaatgcagaaaagccctcctttggctattaggacggagagagcagaagtatgtttagagcttcaaagagtctgactctttgcaactgtttatcttaggactttaaggaagtaaaaggtgcaagtgaaacactctggattataaaatagaatctgacacagaggattcaacccagttaatatgcatgttgcttacatggaaatgctgagaaatttttagcaaatagatagaaaatgacagatggtaggtatatagaaaataattgtaggaaaaaatgtaaaatgaagatttatggtattccttttatattttattttgttaatatgttgcccataatgctttatttcaaagaatgcaaaaccaaaaaagtagttccttcctaacttcccctgcagccttgtcttgtggagcttgtattttacttcatgagaaatgccaaggagatgtcatttaagctgaaacctccagcagaattagccacaatatttgggaaaaagatgtttccagaaaaagaaagagctagtataaatgtccttaggcaagaaagagctcacgatgattgaggaacaacaacaaaaaagattatttcactcaagaaaagtgaattgggagtacagatacaaatgatgaggtctgaatatgattcatggggcaggtcacactagggtgtttgggtatggtctaaatgaatgcgcggcatgagttgctttaaggagaggagtgacatgatttgacaagttcttaagagatccctttgattactctggggagaatagaacataaagtagcagaaatgaaagcaaagggagatagtaggaaataattgcacatttataagcaagaaatgatgttggcttggactctggttatagcaacaaataaagaaaaaaggaaatactgagaagagttgattggatttgctgacattctcaacataaatggaagtcagtatttttttctaataaatataatatgcgtaaatatttttaaatatttaattcttttaccactaatggggcacgagtagacttcagggaacatgccagtacagaaccatataaatgtgatcattggtagagataggaattaataggcatttgaatgtctccctcaacctggaataccacaaataaagctctttgcttttcatgttgcattgttatcataccctatagttttctgccattttcagttacttaatattatgttttgcctcaatagattatagtgctttctcttgttgtgttatatttgcagcaattattagtgaagttttaaacttcaatatcacatctaaaacagagcaaaattgttgcatactattttccattaaaacatgagaccactatgacaaaaaaagctaaacgtgtcatgaaatgacttacattggatgaaagtatatgcaatatattaagaaataatctctgactttatagttttttatttgtagtttttactagaacgtgaaatcaatatgtgaaccctggctggagtttgcatctaaatgtaataaaataaaagaaagtttaatattatcattgaagcattaatgtacattagcgagctggactatataaaataaactttattatatttagcatttgatttttatttatgtatattataaaatgaatatagtttatattataataaaaataaaagaagtagtatgttaactaattagtataagatgcctacaaactacatatctgcctaaatttttgacccatgaaacttcaatgatttgtgttaatgttaaggcctacatttatttatatatatatataattaggggaggaattgttaattctttcattttaaaaattttaactttgcagacaaagttgactatacctgtggcagaacactgcaacagctataaataaataaataaataaataaataaataaataaataacttttattttctgtggagctcccagaattatgaattattctgtagattgagatttgccaaggtccttttcttagagttgcaagagcataggagaaagtcaagggaaataataagcagcacttgatttcctttaccacagtggatgggcttctaaaaccaaattacctgactataaatccagatctatcttctgcaggctatgtgattgtggatgttacctcttctgtgcttcaatttcctcatctgtaaaatggaattatagcctaccctattttgtagtatagtgaggataaatagaatgaatgtatgtagttcttagaatagagcatggcacgtgataagtggtcaataaaatattgtttactactagttatgtaacagtcacttcacacataataatgatttaataaaggaataagaagaatgtagagcacagcttctcaacattggcactatgacattttgggtcagacaattatttaatgcagagggggctataggatgcttagcagtgtctctggccagtagtgtacctcctcctctccaagttttgacaatcacaaaggcttctagacattgacaactatcccctgaaaagtaaaattgtccctgcttgagaacacaaatataaagtaaccactcaaagattacattactaattttaattgaatttgaccagcattatgaaataagcataagcttaagtttctacccttgattttgtcattgtcagttagggcagcagagaactccaattctgaaaattctgaacatgtgctaataccctataatataatcaaaactttcatttttgaattgtatttcttaaaaattagaaaatttattaagcagcaacatggaataattaaccacaaaaatgttgaacataaatctcatttgcctaagttctcttttgaagtcctgtttcactatataagtattatgtgttttgtttcacagctagataacagccagttttttctctgagcctaaggttgctcctcaaatttatggtggcttatagctcttctaagtttctataaaacttcagcaacctgcagcaggttgaaatttattgatattgagttattcaccaggtcatattacaaagtcagggactgactcacccaaaccagatgctccccctgccaccagatcactaggagatattgcaatcatttcccctggctactaaattagcaaaaattctcagggagagagaagggcaagatggcacagtttaatacttactattattcttttattctttatcatcattccctttgaatggattaagaatctgacataaatataacttgctaaagaaagggtgttaggtgagagggaagtcatattggtctaagaaaagtcttagagaaatatttgaaaagaggtagagagaagggttggattggagtgggtgggtggggaatcacactaaggagatggatcattcataatttctttagacatggtgaggcagccacaggagtctgaacttgttgaaaccctagtctgaagccaataaaagtgctcaataaggtcacactttgatcttctctgcctaaagcagttattcaccctatctttgggagaggaaacatctacaaacctttgttctctttgttagcagagggatgacatgaatttgggaaaaacgtttgagagacaaaatgagatttagctcgagcaagtgatcgacttgtgctgggttgcaaatggactttttcaacaggcaggttgaaactgtgcttcagcaattaggataccagatataaacatccatgcacagaattggaaaggttcagctttcatggttgctatggtttgaatgttccctccaaaactcatgttgaaacttaatccaaaatatgacaatatagagaacgagctttttaaagaggggattggatcatgaaagttcttccctcatgagtggattaatccattgataagtcagtggattaataggttatcttgggagggaaaccattagatttataagaaggggaagatagacctgagctagcatgttagcatactcagccctcttgccatatgataccctgtgctaccttgggactcttctgagagtccccacaagcaagaaggctctcaaaagatatgccccatcgaccttggatttccaagccttcttagctgtagaaaataaattcagttctttgtaaattactcagttttaggtatactgctataagcaacagaaaatggactaagacaatggtcttatccagaactttgtaaactagaattggctgtttagattcagtatgtattttttttatagattcaaaataattttgttttgaactgtacaatgaaggagtgtcataagcttttccacatgtagaggctctaaatatcagtctggcattgtgataaagcagagagtttaaacccaatcctatttgtgccccatgaccgttctttctggttacagttcagaaaagtaggaatggatgtgtaactcaaggagaagcatacaatacatgaagctttttctcaaaattttgatttagaaaatgaggtattttagtatgttaattataggcatctcaactgagaagtctaatagcattgggccagaattgtcgcagcagtccaaagccatggataaacttaagttaaagggagcaaatactaacagccttccaaattaatctgtattggagaagatgataaacagatgaatgggaactagaaaccatgcagacttggaactagatataaaacaaacagctatctaatgatttcttatttactctgagcccaagatatttttgtatccttttagttaaacctctgttttactaaggaaatttaaataagattctgtctcttgcaagaaaataacatctaagacatcttcgtatttaatactgccttaattttgtttactccagtggtccccaacctctttggtaccagggattcgtttcgtggaagacaatatttccatggacagggttggggggaaggtttcgggataaaactgctccactactcagatcatcaagcactagattctcacaaggatcaaactagatcacttgcatgcgcagttcacagtagagctggtgcttctgtgagaatcaaatgctgccaatgatctgataggaggctgagctcaggagtaatgctcactcatccacctctcccattctgctgtgtggcccagttcctaacaggcccggtaccagtttgtggcccaggggttgggacccctgttttacactataacatttccacacgtctctcatggcctttcagatccactgcttgtctcaactcaagtccagctacctgaaaattcgattattttttcaaagtgaatttgaatatctttatgttgaatacacagtctccacttttacgcagcccctactgtcttctatcatacctctctagccctggaagagatcaactttacattcacttttcctgttttagggctattattttatcttcaattaccaaaatctatctacatttagatactttaacttgcaaatacatagtaaacaattacagattatttaaaatagcagttttcccatgagtataaaaaaaaagaacaataaaagcaatatttgttgagtattttaaagtgccaggcactgagcagtgtgctttgcttaagtaaatgtttgacaaaataaaaggtcctttaaaagttccatgctttaacattaataaccatataaagataaggttagacttcctatcaaattagcagttttgtgaagataggccttttctgctatatagaatctcctcaaacctgagtgttcgtattatggattatctagtatactccatagctatcaagtttgtgtatgtttctttctcaagcaagttatcttatttctccttatttcttcagacttatcctttcttttcttttcttttcttttttctttttttttgagacagagttgcactcttgttgcctaggctggagtgcaatggcatgatctcggctcatcacaacctctgcctcccgggttcaagtgattctcctgcctcagcctcccgagtagctgggattacgggtatgtgccaccacgtccagctaattttgtatttttagtagagacggggtttctccatgttggtcaggctagtctcgaactccgcccgcctcagcctcccaaagtgctgggattacaggcatgagccaccgagcctggcccctaacctctcatttctaaggaaatgacaaattaagtcttttatgcaaatacagtgtagggtcatttaaaaatattttttgtaataggtgtctctgtacataaatctatttaattttttctcttttacagtaaaaaaggcaatactgtgttttagtttcaccaaaaatttcagtagaccaattgtgtaaagggatacatttatatgaatttttttgacatagtaaaaactaagaggggaagttattcaaatatttcagcataaattccctttccttgaaattgcaatcgtcatgtgtagctacaattcctcagcattcctctgtagtataagtagctacaattcctcagtataagaaacactaaggtggaaaattaattgttaagagaacaaagtcataacaaaacaacaaaacaaaaaagtaggatatagaaacattaactcaatatcactcttgaagctcacataagagaaattattgtactagacactgtggttcatcatccagaccccatcttcatgggaagacatcgatcccacactcatggggaacatcagcagctgacaattcacacctgtacctttcactaaatattgtcctaagacaaactaaaatgaactaactcgcccaaagtggtgcctcctttcagagagcagccattgacccatggctggctaatgtagttatacaaacatgcaactgctttgcatcaatttgggacaactctgaaagaggcccagtaggattggctgaagactcagttcaaagttgtcaaataaagcacaccatgcccagctgaatttacattgtttactatgagtatatcccacgaaatatttaggaattacatatactaaacattattcatgatttatatgaaatttaaattcaactgggcaacttgtacttttacttggtaaatctgggagcttttccttagttgcatctgcatggcaggtaagcatgtcggtatgcccagacctcccttctttgcttccttataagtgcgtcccagaaaacaagcaatcatctcagagccaataggcattgaggcttttgataatcaaactcccaaaggtcaaggaaaaagagagtatcccaaaagcaccaagagaacaaacaaacacataacatacaatggagcttcagtatatctggcagcagacttttcagtggaaaccttacagccaggagagggtgacatgacacatttgaagtgctgtttatgggtcccttcggattgtaacggggaaaacaagaattgtagcaggaagaattaaaagaaaagagagaagctttttttttttttaataatctgatctttttctattgagaggcaggcacccaaatgctgcttctgtcggggagtgaatctgtaaattctttgtaactctgtgctacctatttgttaacctgtgtaatttgttctcctgctgacttcttgcaaacacttgccagtgggtatctgaagcctcttacatcttctgtggcacggacttggcctatatttagcatattcactcatctaaagtgggaagaagaatctggcatcttttctctttctccatcttgccatcaaaagctgcctcaatgagcatgtagccttcagaattttgaaagcaagaagcaggcaacaactggccatgtttagcttcatcttgaaactcttgaggacacctatcaaactttcccaaaactgtctcatcatgtatggttccattgcaggatgggtgcaatgctgagtgccagaaggagagggatatcccattctttccttcttaaaaattgctcccagtctttttgagctctcttcctgtttggaaggagaactaaagcaagtttagttctccttacaaaagagaaaataattaaaagcactctcacttaggtaactaattcactttctatatgataattcttagaatgtctagtcctctctttacataagagtacaggtaattgaggtcagtgaaggttttagttacagaactggtctggctactttttattaaaacctgcaaagacttaactgttcttctataatttagggatactcatcatttaatagggaataaacaaaaatttgagacaaaaggaaattctgtatccatttcatatatatacatgtaaattacatatagaaaaaatggtttagaagaggagttaatatcaatttaaaaacgggaattttaaagctgggaataatacatagcataaatatgtataaggattcagcaaaatgttagttgaaacagggggctaaataaacttgaagtttaagaaagttaagaaatgaacccaaatatgcataaatctgaggacaaaatttgatattgctgctaataaacaagggaggggcatcatattgggaggcttcattaataaaagtaacaaattatgagaacaaatagtcttgttatagtttatctggtgaagcattttaatgaggcatagctgtctgttccattaccgaacgacttttcttatgtgtgctctggtagattttcatatggctacactgaaagatattcccaaatgtctgactaataactctatctataggcaactgttctgaaggtttaaagtaaggaggatggggttcatttagaaccagtgggaaaaaatgctaatgctgggctttgaattttatggatgctgtagctgttatttttcaattaaataaatgttttatatgccatgttttgtagctatcgcagttaaactgccctcatctttttgcccagcaaaaaacccattaagatcttcactgagattgagtctaggtttttataaaattaataactttgctactggtttctcaaaaatgagtagaaatgacttttcaatgcaaatgccagtttttgatacagtgaaattatcctgtctgcagtgactatttgaacttttatcggcaattggacactgagagacttagtatatgaacagatttatccttagattatctaatacatgctttgcaccctgcaccataaaacccgatctatttttaaagccttggttgttctgaaaaatgaaatgaaattgtattaaatggcattttgactggggagaaaaaaaaaaacttcatgtggtttaagagaatggatgccggcaattgactgtctactgtttattcaaaacttatagattagcagccagatgtggcagaaagttggctgatttttcattcacaacaaaaacgatgctgtgcttaatgaatggaggtttgttatcccagtaataagtaaaaggaacatgaaagcccttgtgtttaatgttcatgcaaataagctatttgcaggtggcttttgggcagggtcaagtattttcaaatatttttcaaaactgggtcaagttttttaattgtcaaaaattaccagctagaggaaaacctcctaaaaactttattatgctatttcccaagtaaatgaaatgacaagtcacttatcatttaaaaattacatatgaaaattcttttccttatgatttcgtcaataaataaattctagaggattctagatatatttatttggcatttttttttaatgtggtatcaaattttgtggacattctttagagaatcaaattcttaaaatggcattgaacatttaatttaaaatgtccttcttgaaccatacatgtttattaaaaaattattttatataggttatccattaaaaaacaattttctatatatgtaaacatttatgataactgctcattattttggtccatacttatttatctacctatttattaaacaatacaaatcatacgctttgtaaaaataaaggcctagtctaatattactctctgtcagaaataaaataattcagagaagtctgtattagaagacaaaataaaacaaaacagaaaatgatgagaatcacaaaaccattgccaaatttccagctatggcatttactctccatgtggccttaggtatcttactctcttattttaacctttctttgattactgtaaaaataatttgttactaagaaaccctcttgctttagtagctgtgagtataaaattaagaacataattctcaaaaagtgttttagtcttcctggaaacattttaaaatatcaattaatcattgaacaatacacaatcgcctgatcatttgctaagagagggttgcattctcatctctgttcacttctgtcctttctgagacttacacaggtatgagagctagaaaaaatattaatgtgtagtaattcaaaatttctcattcatgaatcacttcagcagtgcaaagaatactttgtaatttttaaaaggcatttttattaatatacttctactattctaccccaatcaacagcaaatttacctaaatcatgagactactggtacttctaatttttagaaaagaatgacataaactgctaataaacccaatgaatcctttacccgcaatgagaatgtccacgagtcagctcttctgaccctctggccagtgttctggagttactgatctccaactttctaattgaactctagcttggtatgtgagagcagccatgggtgaaccagtggagcaagatttaagccttgacattgccattaatgattcaccacctgttgcaagttcaataagttattcacacaccaaattgtggccgcaaaattctgggagataaactaagttagaaagattgggggtgaataaatgtttgctaaatcagaattgttaatgatagaaatctgtatcttaacaaagttgagaaatcttgtcttcttaacgtgtatttattgacttcccaggatatgtcttagtgaggaaacatagcttctggcatttattattagagtgataaggaataataaaccacagtgcttgagagacagggaaaggcagggggagccagagacacagtaacagaagcagattaattgactgatgaaataaacttgagataagagagcacagaggaggttcaagagatggaaccatatattcctctctatctgctcccaacatcaaggaaattcatagcatattttataatgaatccctgataaatattagtctataattgaaaatctattaaaatgactatttcttagggtacacaaaaatattacaacaaaacaagtaaagaaaagttgccatgggatggaatattatattttcctgcatgtctgcttcaaggcagaatcctaatggtcatgtatgtaggtaaattattctttttacagcaacttctgggaggtggtatttggtgcagtataaaaggcaaggggtgtagtgagggtaaagcgtaagtactttgatcttgagccttgactatattggacttgggatctcggaaatcttggggataagcagtggattaaatccataaattagtaaagtgttgattatacaacaggtagaactacgtgccacttttggagggacagtcttcttttttaaaaaaaacaaaaggccttaaaggctttatgtatatataaagccttttttaattataataaatacatttttttaatgaaacaatctgcacatatacaattccactctcaagaaaggcaattatttacataattatgcagaaattcctataattatgaaaataattgcctttcttcagagtggagttgtatatgtgcagattgtttcattttaagaaaagaaatatttactgatttgattaactgaagttctggatgcttaaaaaatgattaaaatacacagatctactatctgtcttcatgaactttaaatgtcttgtaagaaattcaagtaataaagactacaacatttattatttaactggaacatgtattatttattatcctaactgtggttaggaagcaccattatttattatatctatattaatcaagttgtatcctgtaacaggtttcctgttatccactcatgtcttctaacttctgaagtattgtttaaattacaagggagaaacctagacactacattttctaggatctcaggacaatagagctccaggtgaaattatgctaaataagggcatgagtgtaagatgtggatgtcacagtgaagagatttagagcatttttctggtgacctcctgtttaggtttgacaagcatctaaaatcattgttagcaactttcccataattattgcattttcagcctttatgaaaatagcagcattttttttcctttctttgcccatgcacaccatctaatcatgagataagtctccttctgagtccctaaatacatgacatacatagattgggatctttttctgacctgttcctgtctgatacattcttcaactctaagatgagttcatactcatcttctgaagcccctgggaaatggaaatattttttcatattggatgttggtagagacccatcatttaatgaacatttatgtgccaggatttgtacaagacacttagatacattattcatgtacctcacacaaatgtatcaacaacacaacaaaatgtctgtatgaaataataattattatatcccttatatggaaacagatccagagaggaagatacactagcatgtgtaaatagaggattcaagtattaaacatccatctgtccaactgactacaacctctttcataaaatgctaatttctctcctgcttctaattttcttatcaaaaattgtcatctattgttattgggtctatgggtgggtagtgactccttggtttccattttgttctagcggattactgtcttctttatttttgttctagtgtttattgagagtcctaattaattaacctggctgctctgacttccatcagctcaccattgtctcttctcccagctcataatttctgtaacagagctctaggctatgctgaagttctgctatatgttgccagtctctctagatccaagtgcctcttgtcggccaagtttacatgcacgtgtttaaaatcttcttattgactctatatacaaagtcttcacatgccttcctccttaaaataatagcattgtgagaagaaaaaaaaaatcatcattctttttaaaactaattcaggatgtctatgttatacaacaacaagacgtgggggaatatttacctggtagttctgtccctcgttatcattctcactcattataaaattggtatctgaaaaaaatcttgctgcaaaaacaaaaaaaaaatgtatagggtataaagaaaaagtttgcttcacatcataaccattacccatcccattgccaaagggaagattgtacactacatgattccggggagcagcattcacatagactatagtgtgcatggtacatgcaagagaccccatagtactacccgctttgtcctccttgtagacatgctcacagatgatccatgctccctgacctggagtagtcaaataaaagagtagcatcaatttattaagattctttccagaccattttctaggtattcccattatatattccttcaaatggaaggattttattctgtacatcacatctcactgtacacatttttttctgaaatctgaaatctgagtattttaattttatacagtttcaattgtgagaagtacctgacagactgacctgacctaacactctctaagctaaaacactcataaactagcatagaagctttacacatttatccatttctctaatttacttatctattgtttcctgaaacatctattaatcttgcagttatttgagatgactgtgagcttactatttgccagggatggcatgagcaccttggtttagtctagtgcctggcatttattttcctaaactgtggcagcaagtttagctgtaagcatattttttatcagaacaatcatccatctttaactacatgtgaggaaagtactttcttatattgcattacacatttttatatggccacagaaatccttacttagtctgacaaaattatggtagatttctttctcctaaggtcaaggaaagaatcattctgtactgtttccatggagatgtttctccttttctcaattgccaattgtctactgtgtgtcctgggttccttcttttcatatgtcatgaggattctcaccccagcattctgctcctctgagtcaaagcccttgactttcacttctcaattgttttgtttgcagtttttttgctttcctttatttttcttactctataaatgctatgaaagtgtatgtaaaaatttacccatcttttagtttatatttgttatcaccctttattcatataccaaaccatataggaaatgaatataaggagatctttcttagtaggaggtagaagtaaaattttgtttagaataaaaacagaaaaaaagagaataaaattccatatcaccagtttgcttctaaatgcccaatgtttccacttatgagcttgctactgtacacaacgcaagggcttgtaaaaaattgtctaaatgatagtggttaaggacgtattttaggctaggttactttaaaaaaatatatcatcacttctgccgtcaaaagtgaatttgatgtatcataattgttaaagttgaggagggtcaaggattcttctcattctatggtttccttataaatacactttctaataaatgcctaatttttttctgtgaaattaaaccattagatattgctgaatgtctgtatgtttcttacttttctagaatctcattcttaattatagttttatatttttccttcaacaaagtcttaaaacccatgcagctggtgtctattatttacattctgtgatgtattttatttgactttgtgtttttagtcttttcacagaaatccttttattgtgatcttcttgtccaaaagcacttatttcatatctcttttccatacctatcttcattagcaggttgcatttcagtttcttcagtccttttttagataatatattttactacatctgtcttcacaacactgtatacgctctgatgatcaggtctcccttcttttttttttttaaattctcgtcctctttgggacccgtgacaaagtaaaaggcagatttttttctcacctgacttaaaagtaaaaaggtggccgggcgcagtggctgatgcctgtgattccagcactttgggaggctgagaagggcggatcgcgaggtcaggagatcgagaccatcctggctaacatggtgaaacccgttctctactaaaaatacaaaaaaaaaaaattagccgggcatggtggcgggcgcctgtagtcccagctactcgggaggctgaggcaggagaatggcgtgaacccaggaggcagagcttgcagtgagccgagatcgcgccactgcactccagcctgggagacagagtgagactccatctcaaaaaaaaaaaaaaaaaaaaaaaaaaaaaaagaagtaaaaaggcttcatatgtttctcctctgattcttcttaggcccagcatttccaaaaacaaaatagtacacaaaacattagttgtaatgatacttcaaaaggttcaaatactagtttttggctgctttctgactatatttttcttctaaagaaattttgttatgaagtattgaactattcagtatactttaatattttccaaataaagtttccaaactgatatttaacaatattctcttatattcaaacatattctgaactattttctgctgtgtctctagatcaatatttataaatctagattgttcatgtattttttttcctttgctaactttcaagatcatatcaaaaagcaccactgttgattccattttttatgtttcattatttgaaactatattgacatttttcctcttctttatcattccctgttatctcatctttgtgagtcttccaattaatgttttttcctttgaattatttattttttaactgaaaataaattgtatatatttaaggtgtaccacatgatgtcttaaagtatacatacattgtggaatggctaaatcaagctaaacatacgcattatatgcattaccttgtaatcggaccccttgaggtgtcaatacctcagcatttttagtgattgagataacaaaaattcgaattaggcccttgcttgcttgcataaaagccaacatcccttgttctcacaatacaattgcaaactgctgatttactatttctttgtcaaccaggagaagataactttaaggtaacaaaaaacatttgcagaaggaatgaatgcctataaggatgttgcaactaactgctgaggcccagaagtctggttgctcaggatattatcagagattaaagaaacacagactttccccttggttccctaaaactccccctctcttactgtctagctgcaaaaatatcctctctgcatttttttttttttttttttttttttttgagacggagtctcgctctgtggcccaggctgcagtgcagtggcgcgatctcggctcactgcaacctccgcctcccaggttcacgccattctcctgcctcagcctccctagtagctgggactacaggcgcccgccaccatgcctggctaattttttgtatttttagtagagacggggtttcaccgtgttagccgggatggtctccatctcctgacctcgtaatccgcccgcctcggtctcccaaagtgctgggattacaggcgtgagccaccgcacccggccccctctgcttcgtcttattgttaagacatgtctgagagatcttgccccgttctcactttggccaaatggaataaacttttatctatccccaagcattggtgtgtcagtgtttggtttcaattgagcatcaggtacatgagcccgaatttgggcctctacaacatcttcacctacttactatattttgtgtgtgtggtgagaatacttaaaatctactctattggcaattttcaaatataaatgtattgttattcaccgtagccaccatgatgtgcaatcaattttttgaacttactcctcctggctaactggaattgtgtgtcttttgaccgacatctctgcaatttccccatgccctagcttctgatgactaccaattaactgtctgtttctatgagttttacttatctaaactctctatataagtgagattatgtcatagttgtttttaagtgcctggcttatttcacttgatgtaaagtctcccaggttcatccgtgttgttgcagaagatttcttccctttttaaagcccattaaccttttatagatctggtactgaggcaatgcaagcttattggacaattatatgttatttgaataaattgaaacataacagcttataaagggtcaaatggcagttaatagcctaagaaataggtttggaatattatttcttagcataaaggataatattggtcagagtcttctaggcttgaattcttggctacttagattttatcaagtaaattgtaaaaggatagtcaatcacttttttcacatgaattgctgtatgaatttcgacttgacaagaaagactgtgaaaacaaaaccactattatctgtgaactacctaatgtggaaagaaatatccttaaataaaactttgagaaagtagattactcaattttttcctacagatatcccatatattgtaactaattataatatttaattgaatacaaaatctttcttcttaaggaaagattttattcagttttagaacgttaaagtttctccactctaatatatacagaacttctttaacctttaaaaatattgcttcacttattactcatgataattgggccacatacataattaaaacacaccatttattatttccccttgtaaaagtggcatctggttccccaacttaacttcaaactgtaattttaaacaaataataaagtgttttgaaacattaatgtggttaattgtcttatctattgtctatgttcatcaggagctgtgacatgcccaaaggaaggtaatcagaggaaggaagagaagaagctaagttctagagaatccattaatcatggtttagatgactgaccattttattattttcattttccatttaaaaacgttccatttttaaattggaagggggtatgttttagaatagaataacgaaattccctccatctcctcgtagtgtacgtgattaagaagaacctaacagaaacataaggttctaaggttcttgctggaaataataatcagaactgtaagaattctcttatagaaaacatttaaaaaaggaaattctagcaatagaattcattgttaaaactgtaagtcacaacaatattgtctctgcatgctgactgtactcctctgtaatcttcaaaggcaaacaggaacagtaataatcttttcatgtactctcaacttccttctctgaaaggctagaaaatgtcttatatgtagcactcatactgtcatttaatcaaacccagtttctatttttcttcaatttctagaggaatggctacttagtctttctggcataatgtgaatttcttaagtgtctgtagactacatctcctatttttacttcttgaagtttctctcaaactgtgataaagagtgtcactctatcggtactgttaataatgtaaattttgtttctctttttgttactgccaagattccactgactgttgaaatataaaagaaaaacagcattaaatcaggtgtgataaaatcacctttttctgtttatctccaccactggcatttattggcacttggaaactatttataaactcatactcttgtaacagtcttgtagctgaaacccactggattcaaaatctattcctagtacttaactttcttctgaaaattccctcatctataaatttgaggatgatgataattgcaaagatgccagggaaatttataatcattactgaactaatccttttgaaaatataaagcagcattaaatgttacgattactaatctttttaattaaagtggcaaatgtgtccaaaaatctgtaactaagttcattactctcatttatgcagctaaacttaagttctaccaaatgtatttttaagttgattaaaaatatggttggcagcatttataaatacccattattaacatgctatactggtaaatatatttctgctcttatgactagagagtgttgtactttagtaaaaaaattatacctcaataattatctgctctcctatttttattttatttgcaatagatatgtatttattcatgcatttgtattcttattgaatgaaggatgttatgtcacttgcattgagtacataggcatccctttcgacaaataaaatcagaatctaaactacagaaccaggttcaagtggggacagaagtacaattttaataaaggtcaaagttttgctagtgtttcacttaaaatttatttttaggctttctgaatgttctcttaaagaaaaagacttaatcatatacgtacttttttgtattgttaacaaggaagaaacatactaatatgaatggtactacatacattatacatgttatacaagagaagaaaattatatattcaagataaacatttttataatcacaatacttcaacataaatgtgttcaatatagtaaagatgcaggttgtataatttgtcaagcaaattctcaattatgtttgaattctatttaaaatcaacattagtattgacaatattcatatttaaggctttttaattatttaaataggttcaagtttgctgtgttcagcattattagttgtaaaagtaggctctggtaccgaaaatatatatttttagctcccttctgtcagtctttccattaaatgctatagactcacagttttacatgcttctcagcacctcactgctcttgttgcctataatattttattagtttaatccttctgaaataatcctggtcattcaaaaccaatacatcaaaatcttctagagtgaacaaaagaaaaaacttttgtgaagattaaaagaaaaaggagacttctcagatatattaactttaaagactatatctcacaattatgtaatatatttgttgctttatctaattagatttgcatttcttatatataccatgcatataaaaatatatttgatacaaattataatacaaggcatacaaaaatagaccattataataacagaacattttctaaagggattttaaaactgtaagccaaatgccttaatctaatactacttctaaaatgtattctaaagaaataatcttgcatgtgtggttagacttaattacagaaatattcattgtaacctttctttagaagtgaatattgaaaactgaaataaatctaaatgtccaactttataattgctagttatggaatactaacaaatgaaatccatgcttttaaaatagcatttagtgaagcaaatatatgttcaaaatacatataaaggaaaaactggtatgttattaaagaagatagaataaaatttattttgagagtgtatgctaataagacagttttgatatttaggaaaattaaaatgttaggtaatattttaaataaaaaaataaattttctgtttgctgagattatacgtattttaaacaatttttaatgtacgctatagacactgaacatgtataatttatgtatcaagaaaaaaatcaataagttcaatttttaaaatcaaaattaaaagtcacataatagatcagagaagataaagatgaattacacttttttctttatctaacaaaagagagtgcatggtttatggagacagacaatttttttctctggttttaactctaagatataaaaggaatctattgtatacatctggaaataagaggtatttaatacctaatgtatattaagattactgttttagctttttttttacaatatagaagtactgtgtgatgacttaccttatcaaccattgaaagagccattttcaaagattgattaaaatcgaagagttccataagcaattttcactaaagcattgaaaactattatccaagattaagaaaatacttttctagggatccctcatatctagggatctaatgaccattagatccaccttgtataatggaattaggacaacccaaagatctggatgattgaattgtcatttggggattattaccatcatacagctcagtttatggcaatttctatacatgtgtttagtattaattgaaggaaactcataggaattagatgccagacatgaagactatatacatatcttcagagcgcttgtgtcctaaactgaaaagtgtgttttaagagtctgggatatgaaaccaccttttctctattcttgtcaaatccatgtcattctagctactgacataatttatgcaatataaatacaaataataataagcaaagttatatgaaaatatgtttccagtatataggtagttttaaccattctttttagaagaaatgtgtgtgtgtgtaaatgtcttaattgttaaaatgattaagtcattcacaggtttgttaatgtttttccatgtagctggagtgataataatttgtattacattttagagtggtttgatgcaaataaataagaaccaactcaaaatgttattgaggttaaactccaagaagacaaaaggaaaactaaaataacaaagtaaactataattaaaacatttcaactaagaaaaaagtaaaaagttaagctatctcagacaatgttcgagattgaagcttgttaattgcaatggaaaaactgctaattaccacaaatagtaatttagaggcataaatattacacaggtgtggctgcaggaagttgatattaatcaaacacatttggcattttcaatgttgcaaaaattacaattgtaaacaccttccatacaatcaaatgttatgtgaattttaaatgagtctcaataaattatactgcataaaaacaggatttttactatggatcataattgttaatgtcttccgtactcaaggttgaaatataaatcaattcactctattatttggtttggaagtttaagaggacaattcacatttcctttgatacactctaccagtgtcactggactggtgatgtgacaagaaaggtcttctgtagaactgaattgcaataatatggagattataacaaaattatatatgtacctaagaatattgactttaaaagccttcttcagattgcaacattgatttccagatctgttgggaactagctgccttacttaatgtaacagtcttggcaatggaataatcatatatatcacccatggataattaatttttaatcattgaaattcactgaaatatgttgaacatgaaaattatacaaatataattttgtatgctgtttcagattctttggaattttattctaagcatcaatcaagatggtatagtacgagaaaggtagaacatgtaattataaattcaggattcaggaagtttatttttctcttctttttaattctctcaaaatgatcttgattcctgcaaagtgttagtgtatctggtaagtaagagtctatttcttttaaacttcatctgtattaaccagctttatatgaccaaaatgtcccccaaatttaaatctttgcacagtaaggccttatatgtacacctggcctcatttcaaaagactaaagcagttgttctcaaattcagctgcacattaatataaactggaaaactgtttaagctcctgatgacaaagccacatgtgagactaatttatgctgaatcactgggccaaggacccaggtatcagcattttttaaaactatagaggaataaccagggttgagaaccactgcacaaaatggtacatgcaacttttatttaagttattttttttaaataaataatggttgaatcgatattgatcttagtaccaagtcatggcaattttttcagacttagagaattcatcctggcattgagattattaaagaacctagaaatccaagtgtttttgtttatatttttcctgtaaatattagagtatgctagtgctcatccttatttgataattttggaaaatatattaaacatttgagattgaatatcaaaaatctctaaaagaattttagaaataccattcttctatgaaataagtaagctcaatcaagatacatattatagtgcccatttaagaaagtctaataataatgcttgcactgcttaaagattaggttgataaattaattattgttaatcctacttgcataatcaacggacacctagcgatggagtcttaagtatagacacagaagttgaatacttttaagaacttttaaatttacatccgggttaagttttactttaaaattatgttgagtggttgtgattagtacatgtgtgattagaaccgtctttctcaggttattacatcatcatatagacacaggaaaaataatagaattaaaaataaagcaagaaaaataatgtaacactttattggcttcagataattattttgagattctaatcctaccaaaacattctgcttttcttaacttgatcctacttttgtttgtttgttttaataaaggatgaaccaatatcctgagaaattttcaaatagggctggttataacactaagaacctagatctcactatgttttagaaaaattgtaaagtatttcaaataatcagtaaagtttcagctctgcaccattgtgtctttgcaatatggggaaagtcacttcacttctctccctctctcgtttttggcacatgtaaggcagagaaaataatatctactccagctatcccacatgttattataaaatataataagagatagaaaatcactttataatgttcaaagtattataaaagtaagccatgattatatgtgggattaacagcagtttgttatttaccatttaatgtattcctaatgtacatttttgccatatttaaaaatgtttacatttcgatttttaagtgaaagagtaacggtatgacattatgccatgttatatctgatgccattatgtcaaacaaacaaacaaaagcattttaaactatttggaatcttaccaaaataaatcttataactatgataatacaggtttttgaggatttagtttgtacgcaaaaacagaggcaataaaggcaaaaatagataaacaggattacttagaattataaaccttgtgcagagcaaaggaaacaggagggtggagggtggagaggcaacctacaaactgggagaaaatatttgcaaaccttatatctcaatgtactagtgactatcaccctaataactagtcatgggagcactgtcatgcatttggtatgttttagttttcgggatgctgccacttaccacggcgggagcctgatccctgcggaatcgactgtagctggacttatcttgaatattctgagccaacataccaaaccataaggtgctaattcattcatgcttgaaggccataataatcaatacacattcacgcacacatgtacgttcacgcacacgtacgttctcacacacccgtacgttcacacacacacgtacgttcacgcagtatttaaaggagtgcttccgattaaatccgcagatctgccctccccccatctctgagtttattgttaaattaggtaagccagcccccaaaaacaagatacttaaattgaacctagtcagagccctaaaaatcataatttaaccatgaacactccaaccctagcccctcgattaacgtaattttctaaaaaatcctaacattctccaaccaaataaaatctcctatttcgatgctaactaaatctctgtcctaatacttatataatacttcaggtatcccgctctgaaaagcttgtatcccagatattatagtcctaaatcaaatataacttcaactacaaatggcccctcagcgaaaacctctgctagttcaacttttttaaaggccctaaacttccaggactgtaaaggaccactttagatttatacctaacaagatcctaccctgacatccccctagtatttcaaaataccactcaaatgtttttcacccagttaatgtagcttaattatttaaagcaaggcactgaaaatgcctagatgggtccgcacaacccggtaaacatagaagtttggtcctggcctgttttttgaattcttagtaaaaaattacacatgcaagcatccccgccccagtgagaatgccctccagatcacctggatcaaagggagcaggtatcaagcacgcataaacgcagctcaaaacactttgctcaaccacacccccatgggaaaaagcagtgataaattttaagtaataagtgaaagtatgactaaactatactaatatttatggttggtaaattttgtgccagccacagcggccatacgataaacccaagctaataaaactcggcataaagagtgtttaaggtctacattcagtaaagctaagctccatctaagtggtaaaaaactccagctgaaataaaacgattacgctccttgaggataagatgcatattgtaacaattttctatatcctccacaatgttttgcagattcaataactatttaatgaattgagttaaatttgcctatactcttacgctcataaataaccttctaattctcaattcctctaaaacatagaaaaaattgccaatataaaaaagcaagaaagaagatattaaccattttgtcattcaaaatatgactcattcttatacaactacctttgtcagcattcttgccattggactatctagactttgacgctggtatatcatggcttgttgttagagaaggtaaagtttggaaaacagaagcagttatgtaaagcaatcttagaaaatccttgagtttcccttagaattttgtgtcttctacatgttttctgtttcacatagattaagtttgcagagttatgtcataatttcatgagcgtatctgtcagagagccctttgaaggcctatttaatccaactaagaccattttttattgttttaataccattgaacttgttctgataattgaggaaaaagagaaagacattccatataatacaccagatgcctaagtgctttggatagtcataagccttttctcctatagcttcctatttagaaatgcctgctcttcagagttttcttaagctttccaacttgctccttccattttataagaataatagtctatttaggaagactattatcaaataaaaatcagaatgatcagtggacacctattttagccttgggatttatatcacaattccctaagactttatatttccagaaaagaaattcaaactaaaggtcacaattactattattatagtaatactgataagatgtgcattttaactaaaagaagttcccactatttttttttctttctacttttcaataatccttgggaccttagtaggagtgtgcagtagtcttgtggtgtatttttagtttaaaagtctgagcatacctaattaccacttggtagatattgttcaaactcacttttgaatccaagtgtttttaccctcatagaattttttttaaaacgagtatttgcttgtttctattatactgtaactattggagctactaggaggccttttaaatttcaccaacaagtaggcagaatggagactaactgaagggttgatgggcttaaagaaaataaataacctaacaaaaccaccaggctaatggcaaaaccaacattaggaaccaagtcactttacttgggattagtggataccaaaatgtgctttctcggaagcagcactttacaaggaaatatggaaatccacctttgttgtccttcagctaaagggaataaaatcatgtactttctataattttaaccctgttataacagatgctacatgaactcaagtggaactctgactgccttgagagctgaataaaatgcatcccaccatccgttgcagccgcatcaaggtattaaaaagagagacagaaggaagaggtgagagaggcacaagttcaacagtgtgaggcagtcagacacaatgggagggagaaagaaataaatgtctgaatgtcattgaaagaagagacaatgaaggcatatgtaagagtcctgctaaagctatggaacctcaggagcctatttgtaagaactacaatttagaatagggaacttgcaatacaatgcctgacctttatttcctttcctgcctcgaacttgtgaaaacctttgattgacttttctatgaacatgaattactgttacaatatttagttgaacaatatgaatttctcaaagcagtaatacagcgctacagcatagcttaacattgtttaagtaatatggtttgcttatatttaagtcatttctaagggacccatgcaaacacagtcaggagatctatttctgatgtatttccaaggctagaaacaaaaaaatgctgttaatgcataaacagtcaaaaaaccatgcactgtggttttacagggacctctatttctaaagatgattgttgcatgagggtctctgcctttatgaagggaaatgtgtagattttaactagctctgtttgtgttttgaaaaagaaaatcatgtttctgcactaaaaaataaattcctaatcaaacctttaaagttaacatttagaacagggacagaaacttctgttgtttcctaagtgttttgctgttgttcctgtttagttttaaatcattttttagaagttttattgaggtataaaaaaattgtacacctttcatatattcacctggatgaatttggacatgtgtgcatacaccaatatcatcatcacaaccaaggtactgaacatacttattcacctccaaaaattttcttgtgttcttttttaatggtggtagtatatttttaagaattcagcctttgagcagggtacgaaggaccttcaacaacaaatgcaaaagtaaatgagctaagttcatataaagggttagctctcagtgagttattcaagttatgatcatatcctcaagaggcttgtaaactgactgtgggtttccagtttggttattcacagataggccttcatttgctcattcacctattcattcatatagccactcattcattctcaagaagaggtatttgtccatatctcaccatgtggatgagcagatggtcagttctcacttcttttgccattaagtgtgctcaccgttgagctccaggatggtattttctctcactttgcgtcattaccaaagtggctatcaagattccctcccctaccttctttttcttttttcaatgtttaagagctggagttaatttcttgactcctttggtaacacatgccgatatataccactcaaggcctgttggattaaactgttaaatttgtcatctagctaatgttttctcagaaccagacaaattaaacagagtcaattgttgaaattatttcaaaagataaacaatcatagaatggaaataaactacagaaagtagggaacaggagtaactaagtctcctagaaaacatttgcagcagatgttaagtatccagtctcgttgttataaatgaatttcaaagaatctcatgaggagcagctttacaaaattttactgcactaacaaatggcagccaacctctgtagtaaacacaaaatactgtaccatcctttgtatctccttaaattaagccaatttctgcttacacagaaaatctgtctgtggaaaacactgcttagaatttgaaagcacattaatctggaagccacaacagaagtgtgcttcagaaaacttcttaatatttttcttgtgagttattctctttacgcttttcacattacaatattaccaagttatcataatgtattttctgcactcccagagcaagataagactctagtagttgctgggaactatgcattgtctaaatatgggttcacattctctcacagtgattctggaatcatacacacaaatgagatcactgctgtcagatcactgggattaagactcaacctctctactcactggccatgtaaatatagatacagtactcagatcctctgaggcttagctaattatcagttgatttggtctacacttaccacattaattatttgaaaggattcgttgatataacatgtgctgacaaccataatcattattaaggcaatgtttaccaatatgtgactttaaaacagatactactattagataacaattcatactatacattcaatatttaaacaacagaattataattttgtgaagcaaattttgtactcaaacagaaaatccaattctataattattttctgcaatattgggtcatagaaccaacaaagaatatatgactggcttagacgtatgtaattacttatgcaattagtaataaaattcttcactcattcctagatttgaatccctgatgctctgcgtagcagctgtatagtcttggacaagttgcttaatctgtctgtacctcgatttcctcatttgtacttcaattttcttatgtggtaaatataaaattacttaactcagagctatgaggtcagttttatttgagagaatccagaataaaatacttagcacacatttcctaccattcagcatgcataatacgtactcaaggaaattttagatctctgtacatgattaatatattaaatcctcaaaccgactataatgtctgaaaatgcatgtctttatgtcactgtacctctcactgcacttggcacagtgttgtgaatatatttgtcatttgtatgttctttctaccatacaattctgccactccaattagcatattgtgttggaaaacaattgggtgcttgccttatgttttactaaatttatacggaactacgttgacacttccttgcccttcagatgctggcactcactggttgctttctagttctcaggagtctctgtgtgactctgtcctttacacttgccctgcaacatcaccctcagccctagacaaagccaacatcatttttaaaaacctgcaaatatgtctgcaattcactgtatgaatattctcattctatcaaaaccctgacctcactaactcaatggagcaatacaggatgagaaagtagtttatatgaaagtcatagaaagcttgctttgtttattcatccaaacgtatgtttttaaaggacgaggcttttatctgaaacaaataaaattataatttgaaatttcaaataatgtgactaatagattatgaattcatttccaaatatagaaataattaaaacacttggggtatagaaaaagtgagtgctgtatctattcttttcttatattaattttaccccagctgccagaatttagttttttgtttttgttttttttctttttctttttttgagaccgagtctcgctctgtcgcccaggctggagtgcagtggcgctatctctccgctcactgcaagctccgcctcccgggttcacaccattctcctgcctcagcctcccgagcagctgggaccacaggcgcctgctaccacgcccggctaattattattattattatttttttttttttttgagacggagtctagctctttcgcccaggccggagtgcagtggcgccatctccgctcactgcaagcttcgcctcccgggttcacgccattctcctgcctcggcctccctagtagctgggactataggcgcccgccaccgcgcccggctacttttttgtgtgtgtttttagtagagacggggtttcaccgtgttcgccaggatggtctcgatctcctgacctcgtgatccgcccgcctcggcctcccaaagtgctgggattacaggcatgagccaccgcgcctagcgcaaagatgtattttactaataccacagaggtataatctgctgctacttcttgatcaggagtaaacaagtttacttcacagcagttgatctaattttcttccccattcattcaatggtattttttttattgttatagaacatactgaattggataataagtccttttctttttcttttttcagaaatggtttctactctgttgctgaggctggagtgcagtggcattatctcgactcactgcagcctctgcctcctgggctcaagaaatccttcgacctcagcctcccgagtagctgggactacaggtgagcaccaccatgtccacctatataatttttgtatttttttttttttttgtagagacagggtttcactgtgttgcctaggttggtctcaatctcctgggttcacaccatcctcctccctcatcatcccaaaattctgggattacaggtgtaagccactgcacccagctgagaaggctttttattataggttgttcttattgttttatttatttggtttacttgttggttttcaaggtaagtttgacatataaggtggtataatgtttaaaggtcaagttatagagatagctagattgaagttcaaatccagagccaagttacttagactctctaaggacttgttttttcccttataaaattaaaataaagtggatagccacttcataggtttgtaataagaattaatatgatcatgatgtcacagagttgcaaagagatactgaaacttggctctgccaaaaaatattagctattgccattatgattgttctccttaatacctaaggcatttgctgacagtcaggttactcatcatgtccttccaggaaaaaaactttaagaatgttgaaaacttaggaactacttttaaaatttaattttcagacctgacataacacagctgaggaagagaggtggtagctgattggggatagatgtagagatcattaatggtataagagtgtgagaatgtgaagcaggataggatatgatattactcatacagatcacaaatacatgtcaaaattatatttatcattcatttaagtaaaattcaacattgttttcttcaaagaagaaattgcgcatttcactctacctatttaactctggaaaattttacaaattgagcatgccattttttagtatgaattcctttatttcagctgccctgctaactttggcatgatgagcagaaaaaaaataaacagaatgattagttctgaaatatgaaaaagtgtccaagaaaaggagtagtcttgagaagtagggaacaggatgaagtcactaggggacagaagggtaggagggagtgggaccagacaaacactgagctctgcatgcacacgtaacagtctaaaatagtcatccagcacgcagactctaagtcaagataaccaagatgaattgccaacttctccacaagcaatatgactttgggtaaggtatttgagttttctgtgtcttagtttcttcaactgataaataaaaatgatggtcatatctacttcataaaattgtgataattgattaatacatgtaatgaataacgtttggcatttagcttaataataagacttttcattaaaatattagctacttttgttagctagcaactctcagttttgcctaaagctgaccccatatctagggtgaggttttgaaagaaattcaacaccatcagaagtaggtctggaagttataaaggaaagcttaaagaaacagaaatatgtgcaacacctatttacaaagaatccattgggaaaaccccattgagcccagggagatggcacatgtcccctttggttatggaattcagttccctgacggtcagtatactgtctttgttcccaaggcaaactttttaataattgtgatcccactcaatagtcatgttcacttactttatgggtacatttgtggcatattttaaaatgtgaagttgagtgcatttcacctgaaaaccaaaggcatgtaatgacaacatgctatagaggaaaaattattgatttgtgtaaataggcagatcttgtttgtattctagctccatcacttactaattttgtgatatgggcaatttatatcctatctgagcctgtgtttcctctacaatatgaggtaatttctactttgaagtattgttatgagggttaaatataaattactttctggtttatgatgttggtatatactacttctatgcacaaccgttatttttatgaataagattttaacagtaagccacagaaaatataatgtaagactgattcttagaatctatcaaaacaggttgtaaaaatgacttaaacatctagcatggcagtgactaacattttgaaaagcttaatttttccattaagaactatagcccaacacagtgtctgtgcttcagtgttcctcttatcaggaaggataatatgtgtgatgcatggactaactctaatgaaaatttttattcttaagacacaaaatatttcccagcacagtacataaggtctttgtgcttatgtcagcattggagataaatttctgggaaagaagtagagaaactgctcatttctatagacatcaaaacaccaaagtagccgggcgcggtcactcatgcctgtaatcccagcactttgggaggccgaggcgggcagatcacctgaggtcaggagttcaagaccagcctcaacatggagaaaccccgtctctactaaaagcacaaaaaattagccgggcatggtggtgcatgcctgtaatcccagctactcgggaggctgaggcagaagaattgcttgaacctgggaggtggaggttgcagtgagccgagatcgtgccattgcactccagcctgggcaacaagagcaaaactctgtctcaaaaaacaaaacaaaaaaaacaaccaaagtaaaagtgaaaataaaggtacacagcagactttttctttttaaatacctaaactgaaaagtatacctgtcaagaaacatccaactcatgaattactttaaatatgtttttaaaacagcgtgcttgttttataacaatagattcatgctagttatctgatattccccagtggttgctttgtggagctcagtgtcatccttggagaacatgggcaataaaaagcatttcttctgcaccagtaagacaaaaacaaactgactacttctcacataaaccttggagggcttccctcagtggggttagtgatcagcaaatcatgtcaaataaccccttttgttatttttgacataatagtgttcctagcagacagtactcaagaattcccagattcttagctgtaacataaatttaatatactctcttttattaaaagtcaagctgtttattcacagtagctcttaggtctacgtttcattttacacatatatgtggatgtaatagctttttccttagaacttttaaaaaatagaattcagtaaaagtcctatatttgtattttctatgtgtcaagaacagataagcatcattaatgtgaaccaaatttcaattgaggagctgaaattaggaagaattgaaaaacacctgaaataaatcttcaagtaataaaggggaaagtttactttagaattagtgtatcaaaaatgagaaaattggctgggcgcagtggctcacgcctgtaatcccagcactttgggaggctgaggcatgcagatcacctgaggtcaggagttcaagacctgcctggccaacatggtgaaaccctgtctccactaaaaatacaaaaattagccgggcatggttgtacatgcctgtggtcccagctactcgggaggctgaggcaggagaaccgcttgaaccccggaggcagaggttgcagtgagccgagatcacaccactgcactcgaaactcggtgacagagcgagactccataaaaatcaatcaataaatcaatcaatcaatcaataaaactttttaaaaagtcattgcattatttttaaaaaattaatagtttcaaaatgtatacatgtaaaatctaactgggaatactttgtatctacttgtagcacaagattaaatttattttcaattactaggagatttgcacaatagagtatatatttactttaatctgtatgactaaaagcctcattgtcaatgtgactatgtcatcattatcacattcatgaatctcctgattataacctgcacagatggtctacctacagggctctgggataagaaacttgctgtctgtctacagaggaagccgttttcacttccagatagttctgaatatttgcaagtacttgctgatttagagtcaaattatgtcttgctgtaacatccatgttactgaacttacatttgagataaaccaagattagactaaaccatgccttcaaatgacactctcaaaaatgtgatgcaatttatgtgccaaaactatcctatcttgccattttcctccattttttaggaaaagcatggtcctagttttgttagccacagttgacactactattttaaatcactatgtcatttgtatatcctacatttgaacactctttagtgtcttcaagttaaaatatgcataaaaactgcacgtccaggatactctacctggagaaaaacatagctctcattaaccttgtccagacattaaacttataagagaaaaatcattattttcctgtaaccaaattactctgctaaattgtttttaggcaggattaataaatctttactgtaaagggaaagaggctaagattttaggttttgtgggccatataatctctatacaactgttcaactctgctgttgcagtgagaaagcatttatagacaatatgcaaatgaatgagtgtgtccatgctgcaataaaatttaatttattgcagtctattggctggatatggcctgcaggccataatttgccaacccttggttgacagtatagctagctaaacactgcttgttgtagtaaaatcttgctttttaaaacatatgtctctcatcctagtattgtcattacgtgtgtgtggtttattgttaaatatgtaatatttaagggtctttcctatttagttttattaactaaaagctgtttcataattgtaatgcacagacatctatataggtttttattttatcattcaacctattagctaatccttagagttgtttcatttttcatgtgtttgacagatgaacatgtctaaaacactgatgataatgttaccagaatataaacaaaaatgaaattttcaggttaaaaccattttgttagtaatatgtaagtatatcaattaaccattaaataatttaccaaattattccattacctaatccatattgctccttcttgtccacaagaatatagtaaggtacattgtcaaatacatacctctgactttagtgggcatttaatgtattattagaggatcctgatatctgtctttcttaaagaaattaaactcatccctagtgattatactttcttcatctaacactataatattaataacatttgaaaaaataatgtctaataattaacactagatttacagagtatttttagacaattttctaaaattatctgaaaaatttgaccagaatcattgtaaaattcacatctgagcttatgaaagcccactttattccactctaaaagaacaaaattttgtacttttaattttatcttttaaaatgttttaacataaaggtagtgggagacgttactaaaggaagcttagatagtaacgtatttgttgtctcagttaacacaaagaccatagatggggcagatctgcaggatgcaaaaactttcctttttctcacctcatagtagtcatatggctactgcaattctctggtttcatgtgcttacaaaatgtcctttagttaaaaataaaaagaaagagaaagagaaagagaaagaaagaaaaagaaagagaaagaagaagaaaagagaaaaaataatttcttcatgtgtctatttaaattaacaaagacgtgaattgtcccagacctccctgtgatgagtaacttcatgtgtcagttttactgggctaagggttacccacatggctgataaaacattatttctgagtatgtctgtgtttccagagaaattagcatttgaataggtaggctgagtgaagaggatcatcctcaccaatatctatgggcatccttcaatctcttcagagcccaaataaaacaaaaaggcagaggaagggtgaatttaatctgtcttcttgagctgggacatccatcttctcttatcctctgatattggaacacctggttctcagacttttgggcttaggttgaactatatcactaactttcctgggcctccatcatgcaggcaggagattgtggaatttctcagtctcgacatccttgtgagccaattcctcccaagaattatcttcttctagctatctctgtctctttctctatctatttcatctgtatcagtatctgtatctctgtgtcgtctatatctgtatcatctgtatctttatctcatctgtctctatctctatctctacctctatgtctacatctgtcttagttatctatctcatttatggttctgtttctctggagaaccttaactaatatagtccttatcttacaactcacttgccagcttaccatgattataaccaagttgatcacttcaaaagaatactaaataatatatattgtttacactaagagatagctagctactctcctcaagctgaatctggcccccacctcacttagtagagcaagcaaactaaatgtagattatacattttttactcattgaaaaaacccaaataataacttatgacatgctaaaatttaaattttgatatacaaataaaattttattagaacacaattatatttattcatttacatttacattatttgtctatggctacttttacactaatgcagcagagtttgttagttgagacagaaacaggccaataaagaccaacatttttacaatataaccctttaaaaaaaaaatggacccttggtttagactgatcaataatcctatgggaggattttaatgattttcatctgtagccaaccaagcacattttttttcttggctaggataaatttagaacatctatgtccttccttaaaatagccccacatacttgaaagtctgattctctcataactatatttttttctctgctgttaaaatttgaactcattctcttcagaaataaagaaagtaacaaaatagaaactaagcagtcccatttttattttgccatttatgagggcctatgccatctagcggtgatttagtatgtatttaacaaccagttcactgagaaaaactgctgtatttttagtttgcttaatttagtggtgttgaatatttcctctatgaccaattttggcttacgaatatgatttctttgaatgcaaagttgggaggagatgagcactgtgtgctcctatgaggagttccatctggctcaaacataaacactattaacatcactttgctcaagacatgtgattctctttcataatgcttcttgcattaactgcaatataaaagttacaatccttattatttttgaaaaactcaatttgtataggactcttgataatattttaatatgtatacattttataattttattgatattttttcttcttttatacttttttttgtttatttatatagtttgttttcacattaaatgggagaaatactgacattgttcaattcacacccagggaaattctgtgtgaatgatatcatattatatttcttttaatgctctaaacaatgttgtgaggtaagtgttatctctgatttgcatatgaagaaacatattccgagattaaaaaattgcccagtttcacacaaggaataaattggagcacaggagttctatatagatagacctgtatgacttcacagagtgaaatggacagataaacaattcactttccaggagaaatcacaggacaatggatatcagaagaaatgatgggaccagggtaatattggatgttttgtatataaaaaactaatgtgggcaacaaaaaagcatataaagtcactgaagcaaaatatatattgtgaaatctaaaagaaaatatgctattggtaggccatggctacattataaaaaacatttcatttcacataaagtatgaatactacactatgactatgagttaatattaaaaaattgaccacataggaaataggagaaaaaagtaacaacactgtggaaagcaaagaaaatgactgcaagatgaagctatcaccaccatctcgtggccacatacggacctcctcagaagcttagatgaataaagggaagagactggagttattaaaatttgtaaactcagagtaaaagccttcctgagctgaggctagacctctgagggagagaaatgttccaactgctgctgttacctctgaagaggcactttctggggctctgaaaaaattggtaaactgaaacaattactgctcctagggcaaggggatgttcttgggagaatatcagcaaggacagcaaacaaacaggaaaaggagatctattcttccattctcttgcctatgtttctctagtacctcccaatagcagtacgtagcaggatcccacttgaaggaacttggaaaacgtagcttgctgatccccatcacggcatcatagcaaatttatttcagagaaatgtggctaaagatcaagattattagtaaatcaatttttttacctaatttttaatctgtattgatttcttataacataaatatctgtggttacagagacctcagtattttctttttcttctgtagcagcatttcaatcttttttgaagttctacctctctttcactgctagttcacaccatgtgagagcaatggacctaatcatcatgggcagtggtcataatatgtctcaacctgcccaaaataaagatgctaccccattaaccatatgttttattttgtaatacgatcatgatccaacctagtctaatgagaaacttaactagaaattttgttggaattattgaggaaaacagtgttcattttctgaaaaagtagcttagctagtaagatataagctcagtgctactagtggccatcttgatgtggaacaatactgagaatatttcttcaggtaatcctacaagaaatgtgtgcaaaacagaaaagaggaagttacaatgagaaatttcttacgtactatattcagtagagcctcagggtagctctaaatctagatacttaataagaatactactgataataaataatactcatatagcaaatactatgtgctaagcattctttcatgtactttataagattaatatatctaatacaaggactgtatgagatagatattattgtccagttttattatgtcctgcaaataaaatgccctgacaaattatattctctcaatcatctttcctttgtttgcaatcaacattttatatgtattcacttattatgtatcactcctttgattcctcaaaatttatttagggctatataaatattttgctactactggaattagcaaaactttaaggttaaattttcaaacatgttattgccctcatcatactgtagcaagaattagtaatcaatgatacataaaccctatttatttatccaaattattccatttcacatcctcacaaaggacactattctgtcaccatttaaccctgttccccaaaatctcctcataaatgcagtttcaaaaacagcaaatagataaattggactttattaaaattaaatttttttttttggtgaaatggagtcttgctctgttgcccaggctggagtcagtggtgccatcttggttcactgcaacctctgcctcctgggttcaagcaattctcctgtctcagtctcccaagtagctgggactacaggcacgcaccaccacgcccggctaatttttgtattattagaagagatggggtttcaccatattggccaggctggtctcgaactcctgaccttgtgatctgcccaccgtggcctcccaacgtgctgggattacaggcatcagccactgcgcctggcccttaaaattaaaaaattttttttaaagtttttatttttttgagacagggtctcatcatgttgcccaggctggagtacagtggcgccatcatggctcactgcagtttcaacctctctagactcaagcggtcctcccacctcagccttctgagtagctgggactgtaggcatgtgccaccacatcccagtaagttttgtattttttgtattatagaaatgggggccaggcacagtgctcactcctgtaataccaacactttgggaggccaaagtagatggatcacttgaggtcaggagttcgagaccagtctggccaacatggtgaaatcccctctctactacaaatacaaaaattagctgggcatggtggcacgcgcctgtaatcccaactacttgagaggctgaggcacgagaatctcttgagtctgggaggtggaggttgtagtgagctgagaccatgccactgcaccccagcctggttgacagggcaagtctgtctcaaaaaaaaaaaaaagaaagaagtggggtttcaccatgttgcctagactggtcttgaattcctgggctcaagcaacctgcctgccttggcctcccaaagtgctgggattacaggtgtgagccactgcacctggccaaaattaaaaacttctatgtttcaaaggacatcattaagaaagtgaaaagacaacctacagaatgggattaaatatttgcaaattgtgtatctgttaagggtctagtatttagaatatgtgaagaactatcacagctccataagaaaaaaacaaataatccaattgaaacaatgggcaggccaggtgtggtggctcacgcctgtaatcccagcactttgggaggccaaggtgggcggatcacgaggtcaggagatcgagaccatcctggctaacatggtgaaaccccgtctctactaaaaatagaaaaaaattagctgggtgtagtggcgggtgcctgtagtcccagctactcgggaggctgaggcaggagaatggtttaaacccaggaggctgcagttgcagtgagtggagatcgcaccactgcactccagcctgggcgacagagcgagactccgtctcaaaaaaaaaaaaaagggcaaagaatttgaagagatatttctccaaagaaaatgtgcaaatggccaaataaacacatgaaatacacacatgaaaaggtgttgaaatcattattcattagggaaatgcaaataaaaatcacagtgaggccaggtgtggtggctcattgcctataatcccagcactttgagagactgagtcaggaagatcacttgagcccagaagttagagaccagcctgggcaacatagggagataggcgtggtttgagcctgtagttccagctagtcgagaagctgaggtgggaggatctgcttgagcctgtgccgtcgaggctgcagtgagcagtgatggcgccactgcactccagcctgggcggcagagcaagaccctgtctctaaaataataatgataataataataataatagagataccaattcacacccactagaatgactataataacttaaaaaaaatctcaaaaaaaaaaaacccaaaaaacaaaaccccaacaactgttggtgaggatgtggagaaatgggaacccttatagggttccttacttatagggatgtaaaatgatacagatgctatgggaaacagtctggcagttcctcaaaaagttaaacatacagttgccatatgacacagcagttccattcctaggtcatcccaagagaaatgacaacatatgtccatacaaatacttgtacatgagtgttaatagcaacaatattcataattgtaaaagagtgggaacaacctaaatgtagatcagctgatgaatggataaacaatacgtggtccagctgggtgtggtggcacacacctgaaatcccagcgctttggaaggccgaggcaggtggatcacctgaggttggaagtttaagaccagcctgaccaacatggagaaaccccatctctactaaaaatacaaaattagccgaacatggtggctcatgcctgtaattccagctacttgggaggctgaggcaagagaatcgcttgaacctgggaggtagaggttgcagtgagccgagatcatgccattgcactccagcctggtcaataagagcgaaactttgtctcaaaaaacaaaacaaaacaaaaacaaaaaccagtatgtggtccatccatacaatggagtattattcagccacaagaaggagtgaagtacagattcatgctgcaacatggataaaccttaaaaacattatgctgagtgaaagaagccacgaaagatcacatatggtatgatcccacttatatgaaatgtttagaacaggaaatccatagagatagaaaagagatcaatggtttctaggagatggggagggaggcaattgggaatgactgttaataggtatgggattctttttaggtgatagaaatgttctggaattagtgtagatggttgcaaaatgtgaatacgctaaaactactgaattgtatactttgaaatggtaaattgtatgctatgtgaattttatctcaattaaaaaaaagtataggccgagtgcagtggctgaagcctgtaatcccaggctttgggaggccgaggcgagtggatcacttgaggccaggagttcgtgaacagcctggccaacatggtgaaaacccatctctattaaaaaaacaaaaattggctgggcgtgttggtacatgcctgtcatcccagctactggggaggctgaggcacgagaattatttgaatccaggaggtagaggttgcagtgagccaagatcacaccactgccctctagcctggtcaacagaacgagactgtcttgaaaaaaaaaagataaattatggtatttgctttggaattaaataattagtaacctttagtaaggtttggtaaaggtttagtaacctttagttaacccagttaacttctgtgtcttatgtttgtctttgtactgaagtagttgaatgccactgacccacagaatgagttgccagagaattggagcaacattctgttgtgggaaagagaatactctgttctaccttaaaattagattcccagcatatcaattgaagggttttaaatagtgagtgatgtgtttcaatttatatttatattatatttacacttgatcttagccaaaagtctgagaagtgattttatattatatttataaagatcactttagctttctcctggagactggattggtagggacaaggtgacattggtgaacttggttagaaagtcagtcaagcccatgtgcagtggctcacgcctataatcccagcactttgggaggccaaggcaggtagatcatctgaggttaggagttcgagaccagcctggccgacatggtgaaaccccttatctactaaaaatacaaagattaggcaggcatggtggtgggtgcctgtaatcccagctactcaggagattgaggcaggagaatcacttgaactcgggaggtagaggttgcagtgagccgagattgcgccactgcactccagcctgggcgacagagcaagactcagtctcaaaaaaacaaaaacaaacaaacaaaaaaccagtcagtactctagggaagaaataacaatagctatattatgacatagtagtgagttgaagataactgaatagccaaaatatattttggagatagtttgatgtgagaggcgaggaaaagtaagtagtcatgtgtggctctttgtttctggctttaataactccagtagttctggaagagacttagtgggaaaattaaggacattttggataaattgagtttgtccaaatggggttgccaagtggagagttgagtaaatgaagctagagctcaggaaagatgtggaccagagttataagtcatatttatttatttatttattttgagacagagtctcgctctgtcgcccaggctggagtgcagtggtgcgatcttggctcactgcaacctccgcctccggggtcaagtgattctcctacctcagcctccagagtagctggtattacaggcgtgggccaccatgcccagctaatttttgtatttttagtagagacgggggtttcaccatgctggccaggctggtctcgaactcccgactttaggtgatcctcctgcctcggcctcccaaagtgtttggattacaggtgtgagctactgcgcccagcataagtcatatttaaaacaatgggaatgggtaggaacacctagggatagagtgtgggaaatagagtagggtccagtatacagctgtgccaaatttcacatgtacaggttagatagtggagtgggtcagttctattgagaatgccctgaaagtttgaataatgataagcacgtccattttaacatcatgaggtagtggtgacgttgtaagaggagtttcagtgtagtgggttgtcatgggttaaaacgttcagattgtcatgggttaaaacgtgaattggatatgaggaagtggagtgtgcaaagatagttttctgaaagttttacttggaagaggacaaaaaattgagactagacagtttgaggaggatgaaaggtcaagaattctaagctagtgataaaaatttcgtcaacatcaatgaataggtaatgtaaacacattaatcctgggatggatgtgagaagagcaaagaaaggagtcatgggggaatatcagctctaaaggttgagtagagaaggaaggagtgatctgagaggtggaaggaggagtaggaattatcatagaaactttaagcttcttgagggcttgtgactgtgtcatgttcatcattttatctgaagttcttatcaacaaagtagctttcagtaaatatttattaaatgaagacaaaaattttaagagccatctgcaatgtcaaatgtagcccacagttgaatgaatatgaggaccgggaagtgtcccttgattttggagttaagcagctgattgccaccttctgtagaacagcttcagtggagtctccatgatagaaataaatgccaggttgctgaggactaagcgtggatatttgttgagagtggagacagtaagtgcaaacattcttttcagaaagctttgctctttttgaagctttgctcatagggagatacaagatagtaggtagaggggcaggctgtgtttagatgagagagacttcagcatgtttatatgctaaatggaaaaaggaaaaaggaagggagaagttgaagatgtagaataaaggaggtgtgtgtgaatgattgtacattgtctttgaggttagtgggaatggagtgaagatactgggttgcagtacagatgagaatacagtttccactgaagtaggaataaaggaacaatagatggtgcagatggggaagtgtttgggtggcaagtgagaattctggatatcaacactttatttttttcagtgaaggggggataaggtcatccactgagattatagtggggatgaaatgatgattgtaggggactgaggagaaaaggagaatttcaagaaagcctctgagggaagtgagagggcaagctgagtgggaatacttagaaaaaatggaatcatggatttttcacggctgtggtatatatatttgtatgaatgatttcctccttctctcagggctcagcagcctgggtgagcacacaattgaacagttggattggtcttggcctgggttttatgcgtcagtgtgacagagagggtaaggaggcaagatatttcagtagcgagagtgtttgaagtggtgggccattgagtctaggctgaatagggaacaaatgacaccagaaggtggctgctgggacatgaagtggttggtgttcaagactggatagtggaattgaagattgaatgggaggagcagttgctgggtatgacagaatacaggatccagctatggagtgggtttatgaagtagagacaacgttcccaagtctttagtgaacatcagagagtgtcatctgttagaactttagctgtggccaggcaaggtggctcatgcctgtaatcccagcactttgggaggccaaggtgggcagatcacctgaggtcgggagtttgagaccagcttgaccaacattgagaaactccatccctattaaaaatacaaaattagctgggcatggtggtgcatgcctgtaatcccagctactcgggaggctgaggcaggataatcgcttgaacctgggaggtggaagtttcggtgagccgagattgcaccattgcactccagcctgggcaacaagagtgaaactcagtctcaaacaaaaaagaacttttgctcaaaggcaggtggtagcagataagaggtaaggaaaatttagtgaagaaaaattcagtttttaaaaacgttttaggctgggtgtggtggctcacgcctataatcccagcactttgggaggccgaggtgggcagctggcttgagcccaggagtttgaaaccagcctgggcaacatggcaaaacctcgtttctacaaaaaatacaaaaaattagtcaggtatggtggcatgcacctgtagtcccagctacttgagaagctgaggtgggaggatctcttgagcccaggaagttgaggctgcagtgagctgtgattgtgccactgcgctccaacctgggcaacagagggaaaccctgtctcaaaaaacccaaaaaaacaaaaaacaacattttattttggtgatggaattctctattgtttcgaagagttttgtttgttttaaagacattaaccagttttctcgagggatattctatgaaaaagtgggttccatcatccaataagtttgagaaactgcaaactctatcccgttggtaattcacaatgaacctcaacttagattaataaaggctctgggaaatgatgttactattaatgatttaacatttattgagcactgtctaaggctctgttctaaggctcccacatgcattattgtttccagtctttacagcaactatctcaatttaagtcacacggctaagctggaatggaagagctgggattcaaatccagaaagacttgctccataggattctcaagcctataaccagtatggaaacaggcttgacattaaatccagcatttccccatcttgtttggttatggaaccttattatcttttagtatttatagagagattagtcagttgtccacggcatggaccctgggaagtgtcgcctgagtcagtttacactggtgactacagtcttttaaacagcattgtttcagactataactagttttttctaacttggttctctgttgataatacttaaatgttatatttatttttctatttgagagccttatattttgacttcaaggcattttctattccctttcacaatgaccttcccaggaatcaaagatattgtcaccaccacacattacatttgagttactaaaacagtttataatccaaatagctatttcactttcctttctctggtctaagattatcttattgtaatttgttttttaaatttagagacagggtcttgctatgttgtccaggccagtctcaaactcctgagtagctgaaaatataggcatgtgtcacctcaaccagtttattgtaaaattttaatgtttagagatcttggagatcatcttttatttttaacagtatttatttagttttgcaggtagagaaaatgacagctgtgtagtgctgtggaaattataataattcatatccaagcttgaatgtcagctctacctctttactatagctgtggccttacaaaacctacttcgtttcttgaaacttgtttcttcctctaaaaagatgaggataatatcttgcagggtggctatgaaaattaagacagttcacacagtatctggcacatggaaagttctcaatgttaattacccatttttttctgtttaaggaaatagtctcaatcctataccatgaatgaattatgaaaatagttggaaaggaaacaacagttttaaatgtaaactgtctcagtcttatgctgacatcagctacatttctggtaaagtgatggtgtcatgatacaggttatattaagagttaaaaccagtttccttctggctttccaactgacataataagcaaaacctgcctgggcaaacatagacctatttattggctcacttattattaatgttaaagtagctttggtgctgacttctcctgttcttgttttaaaatttcactgttgtcatttgaaatctgacagaccttcagaagcttcatagaatgcttaatggtttaaatcgtctctagaacatgtgaagtatcttttccaaagtggttttctccatctgtcagtatgttcaaaatcatgtgtatagggccgggcgccggtggctcacgcctgtaatcccagcactttggaggctgaggcgggtggatcacgagatcaagagatcaagagatcaagaccatcctggctaacatggagaaaccccgtctctactaaaaatataaaaatcagctagccatggtggcacgcacctgtagtcccaactactcgggtagtcccaactacttgggaggctgaggcaggagaatcacttgaaccagggagacggaggttgcagtgagccaagatcgcaccactgcactccagcctgggcaacagtgcaagactctgtctcaaaaaaaaaaaaaaaaaatcatgtatataggacagaattgcttatattttcacatttactactggatgcctgtttggttttcatagcaatcaacttttggagtttatgggcagtacttaacatatataacctaagtgtggataattatttaaaataaggctattggaagaaaaatctatagggatttctcagttttcacaacaactccctgagcaaagaaaaaataggttggtttgagttgtatgtgatgagatttctaatattctatttgaaatgccccctagtaagcactagtgataggtattaatgagctgaatttgatttccagttccaactctgtcccttgcaacttctgtaaccttgaaggtttctctacgtttcagtttcttcatatgtaaaagagattaccaatatttccctcccaaggctgctgtaacagtgaagtgttgaggtttttatttatttattatttatttatttatttatttatttatttatttatttttttgagacagagtcttgctctgtcgcccaggctggagtgcagtggcatgatctcggctcactgcaagctccgcctcccaggttcatgccattctcctgcctcagcctcccgagtagctgggaatacaggcgcccgccaccacgcccggctgattttttctatttttagtagagatggggtttcaccgtgtcagctaggatggtctcgatctcctgacctcgtgatctgcctgcctaggcctcccaaagtgctgggattacaggtgtgaaccactgcacccggctgtgttgaagtttttaatatagccagcacagcatgtggcacatagtaggcacacagccattgcatgtttcttccagacatctcactgcatttttcagtaatattcttttcaagtacgttcttctttctcattccttaacatttaaaagctatattcaagagagaatattaatgtttgccaagtaaactgaaaatatttcctttgcagcccacacttaagagtgttttaggccgggcgcggtggctcatgtctgtaatcccagcgctttgggaggccgaggtgggcggatcacctgaggtcaggagttcgagaccagcctcaatatggagaaaccctgtctctactaaaaatacaaaattagccgggtgtggtggtgcatacctgtaatcccagctacttgggaggctgaggcaggagaattgcttgaacccgggaggcagaggttgcagtgagctgagatcacgccattgcactccagcctgggcaacaagagcgaaactctgtctcaaaaaaaaaaaagagtgttttagcaaaaaatgattttatgtatgacataccttggtttaaatcctggctttttaattgtaatttttttattttttgagacagggtcttactctgtggccaaggctggggtgcagtgatgtgatctctgctcactgcaacctccgcctcccaggctcaggtgattctcccacctgagccacctgagtagctgggagtaaaggtgtgctccactatgcctagctaatttttctatttttagtagagacagagtttcaccatgttgcccaggctggtctcaaactcctgggcttaagctatccaccagcctcggcctcacagtgttgggattacagttgagagccaccaagcccggcctgaatcctggcttttgaatgtaatagtgttgtgaccttaggcaagctacttaacctatccctaaagtattatgaggctaaagtgagtaatagtatgtataaaacatctagttcattgtctggtttgtatattcccaaaataaatgttattattttaagtggaaactgttgtttaatttgataattcatataattcatggcttttgagagcctgctctactcaaagcccgttaagagcaggcaggaacattgtgaacgaatgttgggcatattattatgcaagtgactgaatttggccttgcctgtaatcaggttcagcaaaagtggtattttctttctttctttctttttttttttttttaaattgagacagtctcgtcctgatggccagactggagtgcagtggtgtgatcttggctcactgcatcctccgcctcctaggttcaagcgattcttccacctcagcctcccaaggagctgggatcacaggtatatgtcaccatgcctggctaatttttgtattttttgtagagatgggggttttgccatgttggccaggctggtcttgaactcctgacctccagtgatccacctgcctcggtctcccaaagttctgggattacaggcgtgagccactgaacctggccaaaagtggtattttctattgcatttgaggtaacagaaattgatgggcttgttattgcatttggcatggctttttttttttccatgttgtctttctccactgactgtcaaaaaaaaaaaaaaaaaaaaaggctacattcatgagtgccacaagagagatccatgattcccaagtgctacagcagaccaaggtatattttggtatctaaaatgtttttcatcttttgctgatcttgtttattagaaataaatatgttactctcctgtattaaaatttaacacaatattggcaagctaaatttaatcaaatattctgcccattttaaaattcacttcctagcctgtccatccttccttttattttgttgtttgattttgttttattgtatgcttttagcagcctgaagccatggtttttagtttctgtctgtagtgataagtggaaaggagggatgaggaaggggctttactggcccaaccagaaatagaaactaagaacccaggactgtattatctcccttggacacccaacactatataaaattgattcctgccctggcagactaagcattggaaagctggtgctaagagtgttatgagaattcctaacaaatagaaaagctcaaggattgacactatagtaaaagatttcattttgacatgtttataatttacttatcaagttaacaataaggtgtttttatttatttatttttgtttatttttattttatgttttgagacggagtctcgctctgttgcccaggctggagtgcagtggcttgatcttggctcactgcaagctctgcctcccgggttcacgccattctcctgcctcagcctcccgagtagctgggactacaggcacctgccaccacgcttggctaattttttgtatttttagtaaagacggggtttcaccatgttagccaggatggtctcaaactcctgaacttgtgatccacccgccttggcctcccaaagtgctgggattacaggcgtgagccactgcacctggcctttttttggtatttttagtagagacggagtttcaccatgttggctaggctggtctcgaattcctgacctcaaggcctgccttggcctcccaaaatgctgagattacaggcatgagtcccagtaagatttttaaagggataccaaaataatcaacatttattttagaaggtgactttcttcaatgagatgtcaatgtctactttctgttatatagtgctattgtttcttttttcttttttttctaagtgagggtctcactctatcacccaggctggagtacagtggcatgatctcgggtcactgcaaccttcacctcccaggttcaagcaattctttcacctcagcctccagggtagctggaactacaggtgtgcatgcctcgctaagttttgcatttttagcagttgttggccaggctggtgtactgtttcttttattgactgagatctatatttacacagcatgaaagtctcagttgcattaagtacattcgcattgttatgcaaccatcaccattatctagttccagaattttgccgtcaccctaatagagcttgtatatatgtccccaccaaatcttatgttgaattgtaattcccagtgtttgaggtggggtctggtgagaggtgtttgcgtcatggggcagatccctcatggcatagtgttgtcctcgcagtagtgagttagttctcacgatctccttactccatccacctgcttctcctaaaactttgaaatacgcttggaattgaaagtgtttagtttagattgaggatagttatctaaaagtgacatacagggctcctgctttgctcttccttagtaaatttcctattttattacacagtttactaatacagaggacttgagttttgttatttccatggaaaacattattgaatctaaatttaactagagatgtgtagttcagggagggagagtggttttataatatgaatcttggatttgaaatgaacttaaagcaaatgaataaaaattgtttcattaattataatgtctgaaataatgcatgtttttgtgaataaaaattgatataataaagtttaaagtgacaggagtagatataactaattgtatttataatttcttggaagtaaaataacatttttgaaaaatattatacaatgacctcacatacagtgacctcacttaatctatgtgaggctatacacagtggctcatgcctgtaatcccagcactttgggaggctgaggcaggtgattgcttgagcccaggggcttaagaccagcctgggaaacatggtgagaccctgtctctacaaaaaatacaaaaatcagctgggcatggtgaggcgcacctttggtcccaactacttgggatgctgaggcaggaggatcacttgagcccaggaggttgaggcagcagtgagctgtgatcgcaccactgcactccagcctgggtaacagaatgagaccctatctcaaaaaaaagaaaaaagtctatgtggaagacaccacgttaattgtgttgggtggtttagagatgtttctgtctccttcactgatgaccgtgtgtctctgctgctgtcgctcactggtgattatcaactcaacctcttatatttgttttaacaaatatttatacaccctttgtaaatttgcatgagataaagtcattatagttaaaaaaaaattttttttttttgagacagaatcttgctccattgactaggctgagtgcaatgacatcatcatggctcacggcagcctgaacctcctgggctcaattgatcctcctgcctcagcctcctgagtagctgaaactacaggtgcatgccaccatgcccagcttgttttttattttttgtagagacagggtctcactatgttggcaggctggtctctaactcctgggttcaggtgatcctcctgcctcggcctcccaaagtgttaggatttcaggtgtgagccaccatgcctgtcctatgaagtcattacaaagaaataaaattaattggtttcattggcagtattgaatttcaaagcagaaggggtgcttaagagaaataatgcctttggagtaatttctgatgctagatgaaactcatatctcatttaaggtgtccatctgaattttatgtttggatgattgtgaattattccttaaagcttgaagtgaactctggctctctaggataaattaatctttattcctttaatctttattcccttagggatatattaaagggatcaaatttttttttagagtaatgtaaaattaagggacttcttttgttaggtgaatttctcaggttttaagatatcagtatcattgtggacattgactacattgtctactaaattctgtaattttaacttataattctcagtaattggctgggtgcggtggctgacgcctgtaatcctagcactctgggaggccaaggcggcagatcacctgaggtcaggagttggagaccagcctggccaacagggtgaaaccccgtctctactaaaaatacaaaaaaatgagctgggtgtggtggcgggtgcctgtcatcccagctactggggaggctgaggcaggagaattgcttgaacccaagaggtggaggttgcagtgagttgagaatgcgccattgcactccagcctgggtgacaagagtgaaactccatttcaaaaataaataaataaataataaaaataaaaatacaaaaattagctgggtgtggtggcgggtgcctgtaatcccaactactcgggaggctgaggcaggagagtcgcttgaactcgggaggcggaggttgcaatgagccgagatcacgccactgcactccagcctgggctacaagagtgagactctgtctcaaaataataataataataataattcttagtaatttttgcaatttttttggtacctaaaataatttctgttattgtgttggataactttgtcaacttcactttgggaatatctaaatacaggtagctgcattcgagccagaggaatattgggtttttttgttgttgcttatttttgaggcagccttactttgtcacccagactggagtacattggcacaatcatggctcactgcagccttgaccttctgggctcgtgtgatcctcccaacccagcctcccaagtagttgggactaaaggtgtgcaccaccatgcctggctaatttttaaatttttttgtagggatggaattttgctatgtcacctaggctggtttcaaactcctaggctcaagcagtcctcccaccttggcctcccaaagtgctgggattacaggtatgagccaccacacccagttgagaaatactgggttttaatcaagattattgtctgaatattgagtcttaatgacttttttgattttgtttttttggccatagtatgaagtttgctgttgataaccttctgtactaactagaagtagtatagaaactgcaaattaaaaaaaaaaaacccaggtaaaatgttgatggctgctatttttatttaaggtattaataaaggaaaagaagtcagggacattatggaggtcaagttttatattattaaaactcaacttcatgatttatacatacttagaaatagtctgagtgatgtgtgaccaaaatatgatttctaggaggaatgatagttacatccgtggaatagctgcgtacactttattgttcttggtgcttaaactttagttgtcctgctaagataaaggaagacattctttcagttggaaatcatgataatgtatttctccattgaaacagtatggtttgaacagtgctatatattcatactcattattattccttaaatgaatattttaagctcctgatagaaggcaggtactgtgttatatgctgtttgtgttaccagaatacgaagatgaagagaacaaagtattacacaattcctaatctcacataaatgctatttttttttactagctgtggggagcacaaaataagtggttgaaagtcatctgacacagttacatttattcctttccttttccatggctcttaggaataaattgttctactctatggattaaattgccctttgtttattgcctgggatcccaactttatttcctaattttatttctttgaggaaacgtttcacaagttttataacaaagtataactcaatttggagagcacaatctgtgcataagttggaggctacctattgtgaaatggaaaaatgcttgtcctagcattactgagttaatgtatagctggtagaaagttttcacttttaattgctaacttgcctagtgagagtgaaagattgattacggcaactaaaaagtataaaaactactgagtagtttttaggtacagtcagttcttcagtagaacaagaatcttttttttttttttttttgagacagagtctcgctctgtggcccaggctggagtgcagtggcgggatctcggctcactgcaagctccgcctcccgggttcacgccattctcctgcctcagcctcccaagtagctgggactacaggcgcccgccactacgaccggctaattttttgtatttttagtagagacggggtttcaccgttttagccgggatggtctcgatctcctgacctcgtgatccgcctgcctcggcctcccaaagtgctgggattatgggcgtgagccaccgtgcctggcttcactcagtgttttcagttaggaaacttacattgtttagttttgggacattttcttgaattatttcactggttttttttcctctctgttttctcccgtggattccccattgcatagatgctgaattatcttgactggacctccagttttttcttcttgattctgttgccatctctttgattccttattgtttctgataaattttcctaagtttaatttccgagagctctttggaaaagtatcgattttttttcatggatggagtatctactcttttgacacagggtcttgctctgtcgtggctcactacagctttgattgctcaggctcaagcgatcctcctgccctagccctcccagtagctggtactacaggcctgcaccgccaaacctagctaacttttttgatttttagtagacaaggtctcgctgtgttgcccagactggtctcgaactcttaagcgccaagcatttctcttgcctcagcctcctaaaattctgggattacagtgtagtatcttctgtatcctttccatggacgctaatgatggggtataaaattccttttatttatttattttttattgacatcagaaattcctgctaataaaattctttttaaattttaagtttttttcttcccacagttgtccgtgtttcctccaagttccttttctattttttgttttcctttgttttctttttgtggtagatgctttcctcagatgagtggtaatccttggctatttgcagttatgcctctaaaagctgattggaagctcttagtacctcattggtacttgttgactagagttcactctagggtgatctatctgtgtcatttgctggggcacccttcatgtcagcttctgattacttttcccttttctgaaaagggagagaggtcttttaatttcctgtctggtgggaggaggtctgtatgccacttctgtgggagagtgagggaagtagggcagtgaggatttcagtattcagtacatatgtgttttcttaaggcctctgttttcattaagcctcccccgcaccaatgtgctttatgtttccctgctctgaaatcctcctgagggaataatcctctagaattttgccttggtgggaaatgcatagtaacctaaccatgtggtatttaggaaggtactgagagattgagcgtttcctaaggagctttcagccagccttctttatttagtgctcccttcacacctgtttctacaggcgctatctgttaccagttcctgagccttttgaagattccgtggacgaaggttggtttttggctttccatactgctggtttcttggatctgctatgtcagttaccatttatgcatttgctttctagcttttaagttttgtttatgccttaaaaatacctgatgagggccaggcgtggtggctcaggcctgtaatcccagaactttgggaggtcgaggcaggtagactccttgcatctgggagtttgagagaagcctgggcaacatagcaaaacccgtctctactatagaaaaattaacccggtgtggtggtgcacgcctgtggtcccagctacttgggaggctgaggtgggaggatcgcatgagcctgggatgtggaggttgcagcgtgctgagatcatgtcactgtactccatcctgggtgacagaatgagaccctatctcaaaaacaaaaacaaaaaacccccaaaaaccttattagtattttagcacaatttggggaagaaatgaagttaaatatatgtatgttccatcttctctttacccagaacttatttctaatttttttttttgttaagcatcttttttgttgtggtaaaatatacataaaatttattatttataagtatacagttcagtgacattaagtacattcacaatgttttacagccatcactactttctagttctagaacttttctatcacaccaaaaagaaaccccatacccattaagcagtcactccccattccctccctccctcagcccctggaagccacaaatgtgctttttgtttctatggatttgccttttgtggatatttcatataaatgaagtcattcagtatgtggccttttgtcacatgttttcatttaccataatatttttgtggttcatctatggtatagcatagatcactgcttccttcttttttatggctgaataattttcattgtgtggatatatcacattttgtttatctgttcatcagttgatgaacttttgggttgtttctgctttttctggctattgtaaatagtgctgttatgaacactgatgtacaattttttggggtgaacatttgtttttattcttttaggtatatagctcggtgtggaattgctggatcatatatggtaattctgtctttaacttaatgaggaactgccaatctgttttcctcagtgactgtaccattttatattcctattagcaataaacaagtgtcccaatttctccacatttttgccaacactgttttccattaaaaactttttattatagtcattctagtgggtgtaaagtggtatctttttgttttgatttgcatttccccagtaactaatgacattgagccttttttcatgtgcttgttggccatttgtatatattctttggagaaatgtctgtttaagtcctttgcccactttaaattgtgttgtctttgtgttgtagagttgtaagagttctttatacattctgggtactagacatgattttcaaatttagatacatgattttcaaatcttttgcctctagatgttttttacttttttatttttgatccttgaactcatctatattctatggttgtgatgtaatgatgacagaattggtgtcatttgtgtttatttaccaggttatttggaaggattatattttaggtgctctcctctcccccagtaaatggtattacgacacaagggttataaaggactgataagaaattacttaagacagaaagggaagttggcctgcttccaaaatgtggtcccagcagaagtgaagttagttacaccaataactacagtcaaaaagctatttttaaccatgataatgtacttgttgttattaatattaaagattatatttttccaggtgcagtggctcacatctataatcccagcactttgggaggctcaggcggatggatcacttgagctcaggagtttgagaccagccagggcaacatggtgaaaccccatctctacaaaaaatgaaaaattaaccgggcttggtggtgcgtgcctgtagtcctagctacttgagagtctgaggtgggaggatagcttgagcccaggaggtcaaggctgtggtgagccaagatcgtagcactgcactccagcctgggcaacaggacaagaccctgtctcaaaaacaaaacaaaacaaaacaaaacaaaacaaaacaaaacaaaaccgactatatttctgcattaagtgggggtatggaatcctatctaatatttgagataataattgttatagtattttattgagcttttattgggtaccagatgtgttctaagtttttttcgtgaattattttcattaatcttattcattgttgtgtcctgaatgagtactcacatatttgttgaagggctcaatggtccctaaaaccttagatgctgttttggaaggttaacttgccaaaggtcacatagttggcaaatgatgaagctgagattaacattaagatctgattccaaagtagtctttcttaactgtattgctttatgtggagttttgccattgatgtctagacagaaaatctctagcaatggaaaaaaataatttttaattaattttaatttttttagtgttttgcttcttttttttttattttgtgagccaccgtgcccaattggtttcttttaaaagactagttagcttgtgctttaggcctcttgattaatctgaggtatttaattaatatctttgaaatcctaagatttactgtatcacttctgcaatatctaaatttttccttcttacttatttctgttctccttctacagtcctttctattatgtttaatcatcaaaacgttgttcttgttttctattgcaatctaatttttagtgttatgctgtttccagatgccatttgggtcattttcaaaaaaagatgagtaataattagcaagtaatgaatattgttctttttaccattcattaagaacaattgttaattgtcttattctattgtgaagaatatctgtaattcctgcttagaacctgggttgatagcaggatatcaggaagcactaagtgtacacagaacgatatagctggaaaaagtatatatgttaaagaataatatgttgtctaaggacagaatggaactgatcacacaggttcttttttggtaagcttcaaaacttcttatctcccatgaaagtactttttcttttataatatgcaacaataactttctgtttagttaattagttttaaaacaagcttaaacttataatttataaagaatcatatttgctccctatcattgttttatagctggggctatactgacaaataagaaaaataaaattcctgcccttgtggaggagacagttaaaaaatgagacaaatacatttcagatggaaatgaggacaatggaagaagagtagagcaggatgaaggcatgaagggtgactgagatctggtcaatctttagatagtgtaatacgggaaactgctttgaaaagatgacttttgagcagagatcttaacgtactgagggagtgaaccattcgaggtctggggaaagaattcagcttcctcttcagatgtacaaaattacaagatattgccattcttgtaactgaaaacctataaaagcaggataagaagtacggtttctaaaaacccatcgaagagctgaggatacaagggagcctaaatgaaccaactccagaaagtaatcaaactttcatagtggagaagaaacccatggttgctctaggatggaacaaccaaaggaataggaatccaccatagatgaggggaaaggagaaaccagccacatttttttaaaatcagatttttaatggccacgtatgggctggtttgacaggttaggatcctaagaagccctagcaactctggcaccaaagagcaagtatgcacccacactccagctcctacccacagatgttcactgaatgttcaggagtagtaagccaaaagcctgggccagtgatgaactggcatagataatacctgaggcatttggaacctctcccaagtatagggcaaccacccttagaaggcaggattgctgagaaaaatccagcagaggctctccaggctttcagttctggaatgctgcaggcaggggaagagctagagataactctcaccccacactctggcagtccatgttttcagccaccaaggactggggacagggcagaagaggtgagtgaaactgctctaattcatttcaggccttcacagaatgtaaggaagctgccctccagaaggctggctggggaggaggagcagggctgcacgagggcacctgagcttcagaaagcaaggtgtgcgactggagagcaaggagaatctagcaaaccaaactctgaccgtcgcgcttaatgcagagatagagttcctacagttttttttttctttcttttttaaaatataaacttgaatttttgaaacagtttcagatttaaagaaaaattgccaagatagtatggagagttcccataaatgctgcctctagtttttcctatttttatttaatttatttatttttttagtttttcctatttttaacaccttatattagtatggtatatttgttataattaatgaactaatactgatatattttcattaactaaagtccatactttatttacctaatgttttgggatcccatttagctgtcacgtctccttagggtcctcttggttttggcattttcttagacttgagcttctcatctcttgtttttgatgactgacagttttgaggagtattgttcaggtattttgtagaatgtccttctattgatatctgtttggtatttttgtcattgttacagtgaggttttgtatttttgggacgaagaacatgcaggtgaagtacaatttgctttcctttttttgagacagtgtctcactctgtcacccaggctggagtgcagtggtatgatgacagctcactgcagccttgaactcctgggctcacatgatcctccctccttagcttcctgagtagctgggactacagatgcatgccaccacacctggctaattttttttttttttttaatagagacagagtctcactgtattgcctaggctggtcttgaactcctaggctcatgcaatcctcccacttcagcctcccaagtagttgggactacagacatgtgccactatgcttggcagtaccattttcatcacatcatattaaggggacatactgtcaatatgactaatcagtgttgatattgaccttgatcatctggttgaggtagtgtttgtgtatttctttactacaaagttactcttttttctcctctgtttacatactgtactctttggaaggaagttacatatgcgcagcctacacttaaggcatggggagttatgatacccctcctcaagggcaaagtgtctatataaattatttagatttcttctgcatggaagatttgtctcttcttcctcatttatttatccattcaattttttaaatattagtatggacttatggatattttataccttgggttaaaatcttattattgctttatttattttattgttcaagttgttccagctttggccactgggagctctttcagttggtatgactttttgatataccactgtcagtgtatgtgtgtgtatgtctgtttgcactttctcactttctggcactacaagatgctctagtatatttagagactaaagcatgtagtatatgctttagtatatgctttatctagtatatttttctgtctcaatcctagaattagccatttctccatggagccttggttccttttactggagaatggagaaaccaagatctaggtgctaggtgtacatgttgctactggggtgtttttgcttgtaggccatctcagctgacagagccagaaaatgtatgtatttatactaccctgtatatatccacatatctataaatatttctatatgtatccatccgtatctaattaagctaaacatgagtttatattgatgtattaggttccagttgaatcactacatggatgattctaacttcctgcccttgcttatctgaaaactcctgctccaatagtgagaaatctgtctcctaccatcagccacccatttacttaatcattctactctagtatacatgtaaggtactcccacagttttaaaaactggtggcttggctatgaaacacaagcaggtctctgtaattttacctaggctcagatcccagacctgctcaagtgaaaggcttgatctcagtccttaaatatttgaagccagtgattaactgttaaattaaagctgcatcatagcccacacccagctcagttacatattggattgactcagactcccttctagtgtcctaacagaaaaattgtcatgtctttttctggaagtaaaatattacttaatttaataagtaatctatttttatataaaatgtctggtgtgtaatgaaaagttacaaggcacaagaaaagcaagaaaatgtgaccaaaggtcaagagaagaaatagtcagagatgatccagatttatcagaattatcagacagggatttaaagataattatgaaaaaaatgctagatgattgaatgataaaggttaacgatatgcttgaaaagatggggatttctgtagagtcatggaaattatgccaaagaaccaagttgaaattctattaaatagaggtgaaaaatatactagcagagaccagggaaaacaaaaaaaggaaagaaaagaaaaggaaagggaagggaggggagggaagggagaaagaaaaatacactagcagaaatgaattcattacatgggcttaacagtttatggacatagcagaagaaagaatcagtgaatatgaagacagattggaaagagaaaagacagaaaaagtcagggaggggtagaaaagagattttagatctgtgggataatatcagatggtctaacatatatgtaattggagtttcagaaggagagaagagaacgtggcagaagacatatttgaagaggcaatgctcaggaacttctaaaattgatgaggtcatcaattcacaaatggaggaagttcagcaaatcccaagcaagttaaatacaaaacaaaaataagccaacaaatttaaaaatcccatatataggcatatcataatcaaactgctgaaaactgaagatggaagagatcttaaaagcaacaggagagcaacaggagaataaaagacacattagttatgtgagaatggcaacatgggttatggctattccatgttttagggccagaaaaaaatggagtcttagctgagcatggtggcacatgcttgaacccaggagttcgagtccagcctgggtaaagtagtgagaccccatctctatttaaaaaagaaaagaagtccaggcacggtggctcacacctgtaatctcagaactttgggaggtgggcagatcacaaggtcaagaggtcgagaccatcctggccaacatggtgaaactgcgtctctactaaaaatacaaaaattagccgggtgtggtggtgcacacctgtagtcccagctactcgggaggctgaggcaggagaatcacttgaacccaggaggtggaggttgcagtgagccgagatcatgtgccactgcactccagcctgtcgacagagcgagactcagtctcaaaaacaaagaaagaaaagaaaagaaaaaatagaatgttaaatacaatgggatgacatccataaagagctgaaagaaaaaaaaaaaacaacctgttaacctagatttctatggccagcagaaatagccttcaaaaataatggcaaaataaagactttttggacatatcaaaaagggaaagaatttgtttccagcagacctggactcaaaaaacattaaaacatacacattaacaagatgtgggttttacagcatatatgtgattatacaaccatgaaagaacaaaaaggaggagatggaattatactgtcacacatttcttactctgtgaaaggagactgtagtaacttctggatgcatatgtaatctctagaacaagcactaaaaacacaaacagggataccataaagtcagtacatctgcccaagagggattaactgctacgagaatcattctcctactgtaaacagctagaaaacaggacaaaaatacatgaaacaactgttttcagacattggacaacaggcagcacaggatagtgatccctgagagaagggaaataactgatatgaaccctacaggggttcctataggcagtttccagattgtagcacagagtaggggaatccaaatagagcccaggagagtttggagaagtcaaggcaactagaatttgtggggcagaaaacaagaataaaaggaactacacagaaatctatagaagtaagagaatctttgattggacactcatctgcacatgtgaagtgtggaagtcagcaatgctggagaaagtcacactggaaatcagaacactgaacaattccaggagctcacacagagctgggaatagtttatgtttccattaggcatagtggagagactgtttcatacaaaggacattggctagagtcttcaaagtggggttaaattagctatagactaaaggcctttctaaacctaccctaagcttcaaggcaggttttgaaaggaccaggctgattctaagtaactcaattatgtgccaaaactaaactcttttaaagaatacagtaaatgccagcacctaacaattaaaatgttcagcattaataatatattaatgaaagattactaggcatacaaataaaaagcaggaaaatgacccataaccaggagaaaaatcaatagaaaagagacctagaaatgtggaattattagaaataattctgatgattgaattatcagccaaatatgttaatacaagtattataatgactagtagagaaatgaatgatagataaaaagacacaagccagatgtggtgaatcatgcctacagacttgagggtaggcagatcagcttgcccaacatggcaaaaccctgtctctactaaaaatacaaaaattagctgggtgtggtgggatgtgcctgtaattccagcttgggaggctgaggcacgagaattgcttgaacctgggaggcagaggttgcagtgagctgagaacatgccactgtactccaacctgggtgacggagtgagactttgtcgcaaaaaaaaccaaaagactcacaagtagtatctaaagatgaaaaataccagatataatatccaaaactgggggaaaaactggatgtgattaacagcagattagacactgcggaaaaaaagatcattaaatgtgaaggtatagcagtagaacctattcacactgaagcacaaagagaaaaaaaatactagaacaaagttaatagaacatcagtaaccttgggacaatagcaagttgcctaatacatgtataattggagttccagaaaagtggggaaaggtagaaggcaattactttaggaaacagcgtctgggtggccaggtgggtggctcacacttgtaatcctagcactttggggggccgaggggggtgcagatcatttgagatcaggagtttgagaccagcctgtccaacatggtgaaatctcttctctactaaaaatacaaaaattagctgggcttggtggcatgcgactgtaatctcagcttcttgggaggctgaagcatgagaattgcttgagccagggagatgtaggttgcagtaagccaagatcatgccactacactacagcctgggcaacagagtgagaacctatctcaaaaaaaaaaaaaaaaagaaaaagaaaaagaaaaagaaaataagaaaatagtggctcatcatggtggctcatgcctgtaatcccagcactttgagaggctgagatgagaggattttttgagcacaggagttcaagaccagcctgggcaatttccttaaaaaagaaaaagaaacagtgactataaattttccaaatctgatgataaccataaactctcagatccaagaaactcagtgaactctaaatagaataaacaaatataatcatacctaggtatgtaatgataaaattagtgccagtcatggtggctcatgcctgtaatcctaacactttgggatgctgaggcccggagtttgagaccagcctgggcaacatagtgatacccctatgtctacaaagattaaaaaatagaaatataaaaagttagctaggcatggtggcacttgtctgtaatcccacttacttgggaggctgaggtgggaggattgcttgaactcacgaggtcaaggctgcggtaagccataattgtattccacccagggtgataaagcatgacgggagatcctgtctcaaaacaaaacaaaaccaaaaaaaggcgaggcacagtgactcacacttgtaatcccagcattttgggaggtcaaggtaggatgatcgcttgagcccagaaattggagacaagcctgggcaacatagtgagaccctgtctctcaaaagaaagtttaaaaaggcgggcatggtggcatgggcctgtagtcctgtctactcaggtggctaaggtgggaggattgcttgagcttgggaggttgaggctgcagtgaactgtgttcgtgccactgcactccagcatgggagacagagcaagatcctttgtcaataataacacataaaccaatgttacaatgagaagaaataaattctggtgttcggttttttgttttttttttttctgagatggagtttctctcttgttgcccacgctggagtgcaatggcatagtcttggctcactgcaacctccacctcctggattcaagatgattcttttccctcagcctcccaagtagctgggattacaggtgcatgccaccacacccagctaattttcgtatttttagtccatcacgttagccaggctggtctcaaactcctgatctcaaattctggtgttctattgcacagtggggtgagtatagttaagagtaaaatattattacaaaatagctggaagaggggcttttgaatgttctttcacaagtgagaaatgcaggaggtgatggatacactaactgctctgattggatcattatgcaacatggatatgtatcaaaacatcaaattgtggcccggcgcggtggctcatgctggtaattccagcactttgggagtctgcggtgggtggatcacctgaggtcaggagttcaagactagcctggccaacatggcgaaaccccatctctactaaaaatacaaaaattagctgggtgtggtggtgcatgcctgtaattccagctactcgggagactgaggcgggagaattgcttgaacctgggaggcagaggttgcagtgagctgagattgcgccatcgcactccagcctgggcaacaaagcaagactccatctcaaaaaaaaaaaaatcaaattgtaccccataagtatgtacaattacaatatgacagtttaaaaattaaattaaaaaaaaattctcttgtacttaccagctgaataaaaaataaatttttaaaaggagagaagtcttcttaaaaaccagttatttaccccatcattaagttataatgaactttcttatgggaattctttgataaggaagctcctttatgctgaagttttattcttttcatacctctttagataaatcagtgctttaggagcatatgtcatatgactcaatggcagtgttctaacttggattctagctccacattgtgcaaaggcaaaaaaccagagagtcagtgtggtagttaagaacttatgttctgctgtttgatttcctacatgccagtactccctccactacctgcagtcttcctgacctggggcaagttccttttgtaaactctgttttctagggggatggtggtggaagaaggatggtgatttgagccaggcagtagcaggtagaggtggagaaaagtggtcaaaccctgaatgaacgttaaagataggaccaaaaggatttgatgagaaattggaagtagagcacagggaaaaagaaagatatcagtgatgatgccaaggtttttggcctggggaattgggatagtggagttgttatttgctgagtatgacttttcacaaaggaatgtcaaggcataagtagcaaagttcttttttttttttttttaatttttcttgattgtgtttgttttgtttttcatcttttgtgggaggtgggtggagatgaaagcaagcacaggggttggcaggcatacccctggcacctacctgtgagttcatgattactagttttaaagttcagtcctttttatttttacttttttttttttttttttttttttagagacagtgtctcactctgtcatccaggctggagtgcagtggcacaatcacggcttactgtagccttgatctcccaggctcaggtgatcctttcacttcagcctcctgagtagctgggactacaggcacataccaccctacccagcaatttttttaaaaaattttttgtagcgacatagtcttaccatgttgcctagactggtctcgaactactgagctgaagcaacctgtctgcctcagcctcccaaagtaaagtactgtaattacaagcttgagccaccgtgcgtggccaaattctggccttttgatgttgcatggtgtggatggggaggcaaagtgtgatattttaggaatttgaggatttcttcttcgaccttaggcgtgacattggacaaatgacatctgggctgagacattttctagtaatgctggatccaaaaaactcttatcccattgtctcatagcttcattacacagacctggcggccatgatcctctttttttcccccttagttgccaaacatgggttctctgtcttacctcatttgagtcttacctcagtcttgagagtctcaaatgtgtatcatagtttttagacaaaattcaaccttatttcaattagtatttcattgttatttaaatattttaacaggaaaactgagcaatgtttccctttacctgttaatcctgttataatattttagataaagtgtattagaaggcacattcttcattaatagaatatttattcatgtgtttatatggttcttaactaggaataccatatagtctatctccaaccctttgagaaggaaaaaagatcctgactaaacaggacaccagaagggcatgcctaaactaggactgttctgggcaaatcagaaggcatgttcaccttattctttttattctttctttttctttttttttttttttttgtgacggagtctcgctctgtcgcccaggctggagtacagtgacacgatcttggctcactgcaacctccacctcccaggttcaagcgattctcctgcctcagcctcctgagtagctgggactacaggcacatgccaccatgcctggcaaattttttgtgtttttagtagagacgggggttttgtcgtgttagccaggatggtcttgaactcctgacctcatgacctgtccacttcggcctcccaaagtggtgggattataggcatgacccactgcacctggcctcaccctattcctaaggccagaaaaccagctagagtaaagttcactttctgtttgagtgcttggactttattgggagaaggcaaatgccctggaacaagagtgaaagggagaaattcccgttgtattgcaagccagaataagagaggctcacccacactggcctaaggcatctcagttgttgatgagaatgtgattacagatgtctcacatgaataccaaagacaattgcaaaggaaattaaaagttatgcaaagagagtcgagaagtcagttgtctgctcacaggttggctttagtggctattactttgagatactaaatgagcgatagctttaaacttcaactgcttttgtttctgaggaaaaaaatcatcttatatcctttcataagtcgcataaaaagtggacattttctattattttaaagagtaaatttaggtacaagcatttactaatttttttttttttttttttttttttttgagatggagtctggctttgttgcccaggctggaatgcagtggcgcaatcttggctcactgcaagctccgcctccctggttcacgccatgctcctgcctcagcctccagagtagctgggactacaggcgcccgccaccacgcccagctaattttttgtatttttagtagagacggggtttcacccttttagccaggatggtctcgatctcctgacttcgtgatctgcccgcctcagcctcccaaagtgctgggattgattacaggcgtgagccactgctcccggcctgtaattctttttttttttgagacggagcctcgctctgttgcccaggctggagtgcagtggcgtgatcttggttcactgcaagctccgcctcccgggttcacgccattcttctgcctcagcctcccgagtagctgggactacaggggcccaccaccacgctcggctaattttttgtattttttagtggagacggggtttcaccgtgttagtcaggatggcctcgatctcctgacctcgtgatccgcccgcctcagcctcccaacatttagtaattcttaaaagagttcagcatgaatatacacagtacgtgggttattagtactgtgttgttaacacaaatgaactatgatagcaaattgaatttggttcaatcaggtcaaagaataaaaggatgattttctttaaccaccagcaaaggatagtataatgaaccccatgcaactatcacttaacttcaataatttcaagtttgagtaagttgcagagtagtaatttgaacccacatctctcttgttccaaatcccttgcttttaattacaatcccatgtggcttctttgtcatttgatgctattgagcaactttatgatttttttggtgtttttggtaaaatagacatgaaaaggcattactacagggagttttttcactccctggtaataagaggggaaaagcactctcttttaatgatacatgttttgtaataagcattttttttagttgcagtgttctgcaaagacaaaacctgctgatacagttcatcctgttttagaaatctttgacccattcatcagactctgaccactctaaagataaaggattatggttgtattggtttttccgactgaagcggccttctgcagattgagaaattgtataattattaactgcggtaatggagatgtacttgcaagtttcatctggtatcttaatgacctttaaccctctgagtacacctaaaacatatcctagaattattgaaattaatcagttgtccataacttttctgtctgtataatttggctatcatacgtattttgtttccccctgcccttgccagtttccatcctcctactcacatactcacaactcctataaattggagtatttagtagcagtagcctttggtataaacactttttaaaaatttactattttttgaattaatagggccactttctagtcaagtttttttttttttggggggggggtaaggagggtagggtaacagttccacacttacaagggtatttgtttagaccaagcttgttcaacccacagcctgtggggctgcatgtggtccaggatggctttaaatgcaactcaacatgagtttgtaaactttcttaaaacattatgagttttttttgagaatttttttgagacagagtctcgctctgttgtccaggctggagtgcagtggcccgatcttggctcactgcaacctccacctcctgggttcaagcgattctcctgcctcagcctctggcgtagctgggattacaggtgtgtgccaccactccaagctaatttttgtatttttagtagagacggggttttaccatgttggccaggctggtctcaaactcctgacctcaagtgatctgcccacctcggcctcccaaagtgctgggattataagcatgagccaccgcgcccagcctgcgatttttttttttaagctcattagctatcattagtgttaactgtattttatgtgtggcccaagacaattctccttcttccgttgtggcccagggaagccaaaagattagacacccctgatttagacaaataagtgaaggcacactgaaataacagttatatataataaccttgtgccacccagcgcggtggctcatgcctctaatctcagcactttgggaggctgaggcgggcggatcagctgaggttgggagttcaagaccagcctgacttacatggagaaaccccatctctactaaaaatacaaaattagctgggcatggtggtgcatgcctgtaatctcagctacttgggaggctgaggcaggagaatcgcttgaacccaggaggcagaggttgcagtgagctgagatcgcgccattgcactccagcctgggtgacaaaagcgagactctgtctcaaaaaaaaaaaaaagaaaagaaaagaaaaaaaaaacacaaaaaaaccttgtgttttgtggatctcacattcatctcagatatttcttgccctgggagatcctctgaattctcaggactgcttcgtgtcatccctttatgctctactatcttcccttgcctagaaggcaagtagggctttgaatctcgcctttgattctactgtgatcctatcaaatatagtaatgctagaaatataggtctgaagtttgggagagagattggctcagtatagatatgtaaagcacagctggatatgtagtagttatatgaatgggattggatgaaattctctagaggtgtgtggaatggaaagaggtggcccaaggaggaagagagagagagagaaattggagaggtagaacaatttaggaaagagtaatgttctagaaactaaggagagagtttcacaactgcagtggtgaagcactgtgagttcttatttggcaatttggacttcattattgtcttatcacagataggaaatgaaaggttgcagaacatttaggagaaaatattaagtgaggacacagaagcagtaaatgtcgtatatgccttttaaacattttggagattacccatagtaggcctgtcccttgggtaaggcaattagggcagctttcctgggccctattttggggtggggaatgactcggggactttattatatgactttttttctgaacattaataaaattcagttccaaaattttgtgattaactgtagtcctaagagcctatgaaaaatgcagataatgggcagttccacattggttgaactgccccaggcttctctcttctagagatgctgtcccttccttttaatcctgtagtagctcctatcacttttttttttttttttttttttttgagacagagtcacccagactggagtgcagtggtgtgatctcagctcactgtaacttctgcctcctgggttcaagcgattctcatgcctcagcctcctgagtagctgggattacaggtgcgtgccaccacacctggctaattttcgtatttttatgggattttaccatgttgcctaggctagtcttgaactcctgacctcaggtgatccacctgcctcagccgctgaagtcctgggattacaggcgtgagccaaggctcctggcctcctgtcactttttacaattgtcagtttgtttttcctctcagaaattaagctccttaaagctctctattattgttttgaattcccagggcctagcataatgcccagcacgtaatgttgagtgtttgttatgtgagtgattgaaggaataatccaatacatatctgtcttaagtacaaaagaattccaatatggtggtctcacagagtcaaaaaagcggaatgtttcagaaaagagggattgataaacagtttcaaatggtactaaaagtattgaaaactgacctttggatttggcttctagaaggtcattggtttccatagtgaaaacttttatagcaaaatggttggagtagaagtggttgaagattaaaggagaaatgagatgtaagaaacaacaaacaagtttgtgggggcgggggggttggttttatttttaaagacttgtagctgagcgtgacagtatgtatctgtagtcccagctatttgggaggctgtggctggatgatagcttgagcccagcagcttgaggctgcagtgagccatgattgcaccattgcactccagcctgggtgagagagagagaccctaactcaaaaaataaaataaaataaaataaaataaaataaaataaaataaagatttgaagctaaagggaagaaaccattggagaagaaagccaaagatctgatggaggagaattcattatcatggtaatgttatgcatttgatttgcatatatctaagtattcccaccaacatgttttttttttttttttgagacagagtctcactctgtcacccaggctggagtgctggagtgcagtggcacgatcttggctcactgcaacctcccgggttcaagcgattctcctgcctcagcctccctagtagctgagactacaggctggtgccatcacgccctggtaatttttgtgtttttagtagagatgaagtttcgccatgttggccaggctggtctcggactcctgatctcaggtgatcctcccacttcggcctctcaaagtgctgggattacaggcgtgagccaccacgcctggtcccaaccaacatttcaagataatatatttctccttccacttgggtttgatatattaatgtattttgaacttgaaggcttttgctgtgctatttggggcccctagtggtaaatctaataatgacatgcaatagaacagctaatataccagttattccttatgaaggttattctttctatgaggattaaatgaggttggaatatgtagttatagcaatagtagtgattcttaatcatttttttaaaaagagagtctcgccaggcacgttggctcacacctgtaatcccaaaactttgggaggccaaggtgggtggatcacttgaggtcaggagtttgcgaccagcctggccaacatggtgacaccccatctctactaaaaaaaactaaaattagctgggcgtggtggtagacggctgtaatctcagctactcggtaggttgagaattgcttgaacctgggagacaggaggttgtagtgagctgagatcgcgtcattgcactccagactgggtgacaagagcaaaactctgtctcaaaataaataaataaagggtctcactttgttactcagactgaagtgcagtggtgtgatcatggctcactgcaatgtccgcctctcaggctcaagtaatcctcccacctcagcctccctagtagctgggactataggtgttccaccactatgtccagctaattttaagaaattttttagtttttaaatttttttgtagagatggtggtcttactatgttgtccaagctggcctcaaactcctggtctcaagtgatcctcccacctcggcctcccaaagtgctgggattaccggtgtgagccaccatggctggccaaaaatgagtaatttttttttttttgagatggagtctctctttgtcgcccaggctggagtgcagtggcgaggtcttggctcactgcaacctcctcctcctgggttcaagcgcttctcttgcctcagactcccgagtaactgagactataggcacgggccatcacagccggctaatttttgtatttttagtagagatggggttttgccatcttggcctggctggtcttgaactcctgacctcaagtgatccacccccttggcctcccaaagtgctgcgattacaggcgtgaaccactgtgctctgccccaaaatgactaatttaaaggtgactgtaatatagttaaacaaatgcctcttttcccattctttactaacttgttatttaaatggggcaagtttttacaacataagaaacaggccaggcgcggtggctcacgcctgtaatcccagcactttgaaaggcagaggcgagtggatttcttgaggtcaggagtttgagaccagcctggccgacatggtgaaaccccgtctctactaaaagtacaaaaattagccgggcatggtggcacagactgtaatcccagctaatcagggggctgaagcaggagaattggttgaacctgggaggtggacgttgcagtgagcctagatggcaacactgcagtccagcctgggcaacagagcaagactccatctcaaatgaaacaaacatactaaaaacctattaacttgtttgatgtgagtgtgcttagctttatttcccttaaagagagtctttttatgagatggagtctcactctgttgcccaggctagagtgcagtggtgcaatctaggctcactgcaacctccgcctcctgggttcaagcgagtcttctgcctcagccttcaagtggctgggactacaggcgtgtgctaccacgtccagctaattttttgtttttagtatagacggcgtttcacgctgttaggcaggatggtctcgatctcctgacctcgtgatccacccacctcggcctcccaaagagctgggattacaggtgtgagccactgcgcccggcctaaagagagtctttaggtgaaaaatttttgtgaatattgtgatttctccttaataatttcttgtgtatttatgaattttatataattaaatggcatatcaaaaaaatcacctatgttaattatgtttttgactcagttatattttcttttggtacattattaagttaatatccatatgcaaaaatatgctgacaatatattaattttggatttttcatttttatcagaaatcatgagtggaggatctcaagtccacattttttggggtgctccagttgcttcactgaaaatgacagtatcagaagacacagcttctttaatgtctgttgctgacccctggaaaaaaattcagcttttatacagtcaacattctttatatctgaaggatgaaaaacagcacaaaaatcttgaaaactatgaagtcccagattctattggttctccagatctttgtggtcatttcttagcaaactgtatgaatagacatgttcatgtgaaagatgactttgtacattctgtttctgaaacacagaatatagaatcccagaagattcactcctctagactgagtgacataactagctctaatatgcaaatatgtggatttaaaagcacagttccgcatttaaccgaagaagaaaagtatcaaagcttctcagtgaaaataaaattagagatgaacagcctaaacatcagccagatatatgtggtcagaactttaacacaaatttgtttcagttgggccataaatgtgcagctgtgttggatttggtttgtagtactgaaaaaattaatatagggcctgaagtggtacaaagagagtgtgtgccaacagaatatcatgaaatacaaaaccagtgtttgggattattttcctcgaactcagtagataagtcaaggtctgaagcagcagttaagaaggtctcagaccttaaaatatcaactgataaagaatttctcagtataattacctccagccaggttgctttttttagctcaaaagaaagataaaaggcggagtcctgtaaataaagggaatgtaaacatggagactgaaccaaaggcaagttacggggagataagaatacctgaagagaattcgattcagcttgatggttttacagaagcatatgaaagtggacaaaaccaagcatattcccttgaactttttagtcctgtttgtcctaaaacagaaaatagccgcattcacataaactctgataaaggtcttgaagaacatacaggatctcaagaacttttcagttctgaagatgaactgccaccaaatgagatacatattgagttgtgtagctcaggaatactgtgttcccaactaaataccttccacaaaagtgctattaaaagaagctgtacctctgaagataaagtgggccagtctgaagctctatctggagtccttcaagtagctaagaaaatgaagttgatttctaatggaggagattctgctgtagaaatggatcggagaaatgtgtctgaatttaagagtattaaaaaaacatcattaataaaaaactgtgattctaaaagccagaagtataattgtttagtcatggtgctatctccatgccatgtgaaggaaataaacaaaattcggaccaaattctggctctaaagtgcctttagcaacagttacagtaagtgatcaatcagaaactaagaagaaggtttttctgtggaggactgcagcattttgggcatttacagtgtttcttggagatataattttactcacgggtgaggtcattatggtatagtggtagcttattttataaagctaagttttgtttgtttttgtttttctcccacttagtctttgaagactctttctttagtcatttgcctcttctgagctcagcataattgatccctttattgcatctgcattgctctcctttccattgtccactctcctgcccattgccacttctgggcctctgttctatccttctcagctctgccccttctttccacttatcccctcctttaataagccttccctagtcaggtggagtgggtcacacttgtaatcccagcactttgggaggctgaggcaggaagattgcttgaggccaggaatttgagaccagccttggcaacacagaacccgtctctacaaaaaataaattaagttttgcgtgcctgtagtcccagatacccaggaggctgacatgagaggattgcttgagcccaggaggttgaggctgcagtgagctttgattgggccactgcactctagcccgagcaacagagttagacctttctgcttctttacctaatgtctaataatgctgtgcacattgtgtttttactgtgggaacagttattgatttctgttgccttattttattatcaaaattatattaattacacttggaaatatggaaaggaaaaaactggtattataccaacttcatataaccaccaatagagttcgagagtgttgccttccagttattttctctgttctccttaaaatgtgtgtgcatgtgtgtatatatcacacatagaagctcatatttattgggagcttagtttgtgagaccctgttttagattttacatgcatatttcattacaacaagtatatgaggaaggtactgatttttatccccacttttcagttgaggaagctgaagcccagagaagtaaagtaacttgtccaatgtcatacatctaggaagtggcaaagctatagtttctcctagactccagaatttatactcttactatatagttgtaaccataaagaacattttgtttttttaatttttaatttatttatttttaagagacagagtcttgctatgttgccaagtgcagtgggtactcacgggcacaatcccattactgatcagcatgagaatttttgaattgttatttttaattttttgtttgtttgtttaataaggacaggatctcactgcattacccagtctgatctccaactcctgggctcaattgatcctcctgccgcagcctcccaaagtgctaggattacaggcgtgagctaccgtgcccatggtatttttaacatgcccttgtttccaacctggaccagttcacccctccttagggaacctgtggtcctccactcccaggaggtcactatattgatggcaagcttagtgcaaacacctgatcggctacaactctgaactcctgggctcaagtgagcctcctgcctcagtctcccaagtagccaggactacaggcacgcatgccgctgcacccagagagaatatttaatttttttttttttttttgagacagtcttgctctgtcacccaggctggagcgcagtggcacaatcttgactcactgcaacctccgcctcctgggtgcaggtgattctcctgcctcagcctttcgagtagctgagattacaggtgcaagccaccatgcctggctaatttttgtatttttatagagacggggtttcaccatgttggccgggctggtttcgaactcctgtcctcaggtgatccgcccacctcgccctcccaaaatgctaggattacaagtgtgagccaccgtgcctggccagaatatgttttcatcgaacacatctaacattgtgttacgtgttctttgttgatttaaaattgacacatggtgtattagagcaggaggaagttgattaagcttaataaaatatctaaagaaagaatgtgatacagaggcggtatttagaaaaagaaaacttcgaagcaatattgatagtcctaccaaatagtttacaggaggaatgagaaccttagctaatgtacttggtgttcctgtaggattgtcaagtacaatctttttttttttttttttgagacggagtctggctctggcacccaggctggagtgcagtggcgcgatgtctgctcactgcaagctccgcctcccgggttcacgccgttttcctgcctcagcctcccgaatagctgggactacaggcgcctgccaccgcgcgcggctaatttttttgtacttttagtagagacagggtttcactgtgttagccaggatggtctcgatatcctcacctcgtgatctgcccgcctcggcctcccaaagtgctgggattacaggcgtgagccaccgcgcccggccgagtacaatcttttataaagaagtaaacacaaaattgtaatgaacaggcttagcatagccacatcccactggcagtattagctaatattatttatatgtgattatattattggaggttcaattcacctaactccctctgttctgattcagtgcttgctgaatacctctttgcttgtgatttggctttctagttgtagagctgcccacagcatgagaacaggctgaaatactgtttttttggggcaattattgtaaatgaaaaaaaaatgtttttttttctttaatttgtttcattaattgatttagtatgagcttatgttgcagagctgaaatctagttttggagtgttaacaaaattaagtttcccagactgtaaaagagggctggatcctggaccatggtcattttaccgaggcaattaatgtcagcagggacctctcaggggccttttcctttttcctaggtaggtgtaaactcaactctgcaatctctgtattttttcctaacatctctatagttgttaacgactaggtaacattctctctggtggctgtaatgcaatttacttaaccattttcctattataagacatttagatgatttctatgaacatttttttaaaaaatcagattttttttgtctttttaagaaaaagaggatctagttcaccgatttctgaataagtttcttttgtgtggaacagatggaaatgttgggaaaaaaaagaaatctacacttttctgttgtcctaatgaggcagtgaacttagttggatagcttgggtagtttatactacctattgatatatacccccaaacagaaatcttcctttttttttttttttttttgagatggagtcttgctctgttgcccaggctggagtgcagtggcgtgatctcggctcactgcaacctctgcctcctgggttcaagtgattctcctgcctcagcctcccaagtagctgggactacaggagcccgccaccacgcctgactaatttttgtatttttagtagaggcagggtttcaccatattggccgggctggtctcgaactcctgaccttgtgatctgcccacctcggcctcccaaagttctgggattacaggtgtgagccagcgcgctcggcccatactgaaaaatttgaagtaacagatgtattccagaccttgttgaataccaacacagtagacagtttgctattataacttctagcaatagaatgaagagatgccaaaaataaggattacctaagggagactactgactagaattagaagaagatgggaggcttaacattgggaaaccacagtgtttaaaggacaaacagaataaggactaggagctggggcatgtcagtgagagggtaggaaggagccaggaggccagggtgggctacccatcccctccatgcaccactagtgattaccatgtcactaatccaacataggcttcacagtcctagctttcagaatgctctccttgaaatttcttgtctgttccttttttctgaagaacatgcatcctgaatgttggatcatgaaaagtcttgaatgctgtactagctcttcctggctaggcagtggggaaccactgttttttagtaagtcacctgaactcattaatgctctgatatatcactcgcctgaactcattactgctctgataaatgactcattagcattgtaagaaatgggttgcaggcgggacaagcacctgttgggagggaaaggaatgtgtaatgtaaaacagtagtagtggtggggcatgggcacatttaagcagcagaggggtaggtgggagctggtggcaaggagtgggaagggagaggcaagatgacttcagattttagtttacttgattagcagcatagcatcaataaatgagttgggcgctatgaaaggaaaagcagatttggacattgctgagtttggggagccaatggaatatccaggtgggaatttccattaggcagttgtagataaaaggttcaaaagctgaggaaagggtctggaatctaaatctgtaagtaatcacttggaatttatacatccttggttttctttcctattatctctaaattatttcactattgttaatatatgtttatacctctgacactgtatgctgattagatcctgccttagagatagctcccttcccctctttctctttacagctcacatgttttgctctacctacaattgtttctacctgttggtatgtttagttctacctgattctactctatccgtcttagatatacagctctctctttccaattggaaaatgttccctacctccaaagtctttcacttttaacttatgtggaagataattatcgtgctatttagggaaaaataatcaagtgtgttatattcagatatatttatagtagaagggaccagtgcatactgaatattattactctcctaggcactacggctttggaaccactactttgccttctggtcctaaaaaaaattatttttgatgtatcagaaatatacatgataacattttccttatgtaaataaaaactattaaaccttttttatatagagcagtggacttccatactgctatcatttgaatataaagaagaaattttgttaatttacctagatttagattttagatttgctgttttgtcatttcgtgcccttaggcaggttatttaacctatttgatctctagttgcttggtatatgggaggcatgcataatattttgctgtgactagtaggttaaccacattgtgaaggaatttatggcatgatcagaatgttttttctctctctagatgttgttattcatgaggaccaatggattggtgagacagtactacaatcaacatttagcagtcagttattaaatcttgggagttattcatctattcagcctgaagaatgtaaggcacattttaaatgaagtaatgtattagtgtttaaagtataaaaacatactaggaaagattagggttaaaatggttcttttacaaaatgttttctaaacagttggagagtattggtttcttttcattagtaagaatgaaaatagaattttaagaaatgaacttgtacattgtaaatcacatttattttaagaagtattgggtctcatgtttcgttttcttaggctgtcagtatagtggtggttcttcaccttttagggagtcagagacctctttgagaatctatagaccatttctccagaaaactggacttatgtagataggcacaaaattttgcttataattctaaagcattccgtggacctctgaagttcttctgtggaacttctgagcctctgattaagaatccttgaggtaataaaaatgtattggtctcgtattcagacagctgtggtttgaatccttattctcctgtctaccactgctaagaaaagctatttttcttctttaatgtccagttttctcttctttaaaagaagctgtttaatgaggaaactagcagctatctcctcctctaggaaataaaataacataaaaaaaaagaaagaaaacaaagtaagggaaacagtataaacttgtggttttggtcactggactcagatagaccaggatttgaatcctggccctcttacttccagtctttgtctttaggcaagttatttcacttcactatacctttatctccttttctttgaaatggagataaaaatacatatataccttatagggttgttatgaagattaagtgagaaaatgaatataagatgttgaacctgcacataatgtagtagtaacatagtaatattagagggagaaataataagctagcaaaatatatttgataaaatgctgaaatatcatacaagaaaatagctagagaaatatactgattatacaagaagataactggaataataggaaagttataggatgtatatggaagatagagcatggaattccaatctttgaattcttaaagaaaggcagagcaagtagaagggaagagcaacaattagaataacaagaactgtgtttgggatgggcaaggtttcattatatactagggtggcccatcagcagaaaaccaactctgacatatttcatagacaactcaaatagagttcttcatctatccaatatatatttattatgtgttgacattgtttcaggcactgtgtttactgtacactgggggtacaatggtgcctgtcctcctggagcttatgttctcatgtggaagacagaccaaaaaaaatgaatgaaacagacatataagtaaaatatttgcaggtgataatgagtgctatgaaggaaactaacaaagggttaagatacagaatgccatggttctagttgagaaggattgatcatggagtagaatcagggttaggaagttgttacaatagctgcagttgagagataatgggaggccagtggagctaaagagccgagatatatttgtaaatagagttaataggattttctgatgatgtgggtctggggatcaggtaagagggacaatctactgctactggattactggtttaagtaactaggtagcctttattgggaaagactgagagggaactggtttgtggggaaaagggctatgtttcaaggcatgttaagttttagatatctttgagatattcaagtggagatgtcatataagaactggaaacaaagttcaggactcagaagacaggtttaaaattaagaggcaaattttagagttattagcatacagataatatttcaaatttaaaagtttttaaaataaatattatctgtataattatagaatcacaggggattgcaaaaataatacataaagtcccatgaactcttcttctagcttctcccaatggtgatatcttatataactttagtacaatatcaacaacaggaaatcaacatttgtataatactgttaactagtaatatactaggatactttccctttcagtatcaataaatatagtatcagcctggcacagtggcttatgcctgtaatcccagcactctgggtggctgaggcaggaggattacttgggcccaggagctcgacaccagcctggatgatatggtgaaacctcatctctactacaaatatggaaaaattagccaggtgtagtggtgcacacctgtagttacagctactggggaggcttaagtgggaaagaaagttgaggctgcagtgagccatgatagtaccacagcacttctgcctgggtgaccagagtcagaccttgtctcaaaaaaaatttttttcttaaataaataaatatagcatcaatacagcattataatatgattaatactatatcaataaaatagatacttagtcctaatgccaatgtcttatttaatagaaaagcactcgaggcattgtcattaaaaccaggaaaaagataaggatgtccactatctctgcaactattcatcttatactagaattatcagctaatgcacttagacaagaagaggcatctggtctggtgcggtggctcacgcctgtaatcccagcactttgagaggccaaagtgggcggatcacttgaggccaggagtttgggaccagcctggccaacatagcaaaaccctgtctgtactaaaaagatgaaaaattagccaggtgtggtggtgcatgcctgtggtcccagctactcaggaggctgaggcatgagaattgcctgaacctaggaggtggaggttgcagtgagcacctgtacactgcactgcagcctgagggacagagcgagattctgtctctccaaaaaaaaaaaaaaaaaaaaaaaaaagaaagaagaggcatttgaacatttgaatggataaagaagaatgaaaattatctctatttacaaatgctctgataacatacctgaaaactccagggaatcaaagttaaaacaaatttaaacaataagataattcaatgatataacaggatgcaaaattaatgttaaaaaatatcattaggctgagtgcagtggtttgcgtctgtaattctagccctttgggagatgaaagtgggtggacagcttgagcccaggaattcaagaccagcctgggctacaaaaaagaaaaaggaaaggaaaaagaaaaagaaaaaaatgctgggtgtggtggcacacacctgtggtcccagctgtttgggaggctgaggtaaaaggattgcttgagcccaggctgggggatgaggttgcagtgagctgtgattgcaccactgtactccagcctgggcaacagagcaaggccctgtctcaaaaaaaaaataataataatagtaattagacaatatacacaaataataaacagagggcataatgatagtgaaaaactcatttactatagtaataaagaagatagttcaaaatacagttaacaagaaatatgcaaagcctatatgaggaaaaaatttaaacactccagaaagaaatgaagacatgaataaatggaaagacattccctgttcttggataggatgactcaacattataatgatgtcagttcttcctaagttaatatgtaaattcaatgtagttccaatgaaaatatatatgttgtggcatataaaagttgatactaaagctcatatgggaaaacagacatgcaagaatagctaggaaaagactgacaaaggaaaactacagaggaggggaactagctttaccagatgttaaaacatactataaagcctctgtaattaaaacagtgaagtactgatgcatgaatagacaagtagaccagtggaacagagtaagaagattagaattagacccacctacatatagcaatttaatatatgacaaagatagtatctggaatcagtgagataaaagctaacttcttaataaatggtgctgagacaactgggtagccatttggaaaaaagggaaaattggacacatatctcacaacaaacagtaataaacaccatatggattaatagtctaaatgtaaaaaataaaatcatgcaacaacaagaaggaaacctgaatgaatcctctgtaatcttggtgtagggaaaggctttttcttaatattactcagaatccaggggcagtagaagataaactgatacattttactacagaaaaataaattttgcataaccaaaacactataaacaaagtcaaaagacaactgacaaacttggagaaaatatttgtaacatacaacaaaaggctaatatccctaatatataaagaacttttaaaccttgagtgacaaagtctgggtgtggttgttcacactggtaatcatagcattttggaaagctgaggtgggagaatcacttgagctcaggagtttgagtccagcctgggcaacatagtgagaccctgtctctacaaaaagtcaaaaaattagccaggtgtggtggtgcatgcctatggtcccagctacgtaggaggctgaggcaggaggattgtttgagcccaggaggtcgaggctgcagtgagctgtattcatgccactgcactctagcctggcaaaagggaaaatgtgaaaaagagatgaacagtcaattttcaaaaaaagatataaaaatggctatcaaatataacttattagagaaattcaaattaaaactacatggagataccatttctcacctatcagattggcaaaattaaaaaaaaaaatcacattctgttggcgcaactgtgaggtaatgtgccctcttatacattggtggtaggaatgcaaattgctacaacccttttgaagggatatttggcaatatctaacaaaattacatatgtacttagctttcaacctagcaatcccacttctaggaatctaccctgaagctacacctccaacaatatgaaaatacatatcagaaggttattcattgcagtattgtttataattgcaaaatatataggagaatgattcactaagttatggtgcattcacatagtggaacactatgtactatgcagctgtacaaaaagaatgaaaaagatctctacaaactgatatggagtgattcccaggacatactgttatgtgaaaacataaaccccccaaaactatatgtagtatgctgtccctcctgtaagaaggaatggaggaataagaaaatacctctgtttatttgtggaaagaaaatgcaggaaggataaaccagaaactaaagagattggtcacctacagggggcacgtaggagaggggtggaagaaagtggggaatgggaacaggatagcaggggtcaggaggaagtgacactaacaaatgaatgtattattgttacaaatgaacctaatattgttacaaatgaataaaataactacatagaagggggtggggaagaaaagaacaaacctaagtagctgtggaaaagagtatattgactggattctataaggctaatgacagaaaggactgtacataaatgctgcaatctagttagaaatatgtttctcaaaggcgaatggcttagcaataaccttatgtacatactagaatgaacaaatgagtacatagattgcagataaggaaagctggatttctcactgttggagaaagaaattataaacaagggaaggttaaaacgaaccagaggtatcgttataaactgaggatttttaatatagataaatggatacagaaatataggcatgtgtatatgggtgggatagtacacatacataaacatctcctagttctgtccattgagcgagcacagcacagatgcagttactcctcagtaataatgagcatacctggtgcccagatcttcatctgtaaacattttcttttcttttcttttctttttttttttttttttttgagatggactcttgttctgtcacccaggctggagtgcagtggcgtgatcttggctcactgcaacctctgcctcctgggttcgagcaattctcctgcttcagcctcccaagtagctgggactacaggtacgtgccaccacgcccagataatttttgtatttttagtagagatggggtttcaccatgttggccaggctggtcttgaactcctgacctcaaatgatctgcccactttggcctcccaaagtgctgagattgcacgtgtgagccaccgtgcccggcctctcgttttttttgagacagggtctggctctgttgcccaggctagagtacagtggtgcgatctcggcttactccaacttccgcctcctgggctcaagccagcctcccacttcagccttccaagtagccggtaccataggtgtgcactaccacgcctggctaatttttgtatttcttgtagagactggatttcaccatgttgctctggctggtctcggactcctgggcttcagcagtccacccatcttggcctcccaaaatgctgggattacaggtgtgagccattgtgcctggccaacatagttctctaatgaaaggaaccagctctgctaaaagtggttgattacaggactgggtcagggcaaattcaggataagcctggaagtctagtggtgccagacaagacatgttgaaataatgcaagagccaacctgaaggaacacctactggctaaagctgaagcaatttgagtaagaaaataatgatagtattggattagaacccatagattaaaatctttacaaatccttattgatataaagatatatttatttcattaactaaccagaggggaagagaaagctcttccttccaatggaattccaattaataaatctgagagaaaagaaaaaaaaatagagaattactggccatgctcagtggttcatgcctataatcccagcactttgggaggctgaggcaggtggatggcttgagcccaggagttcgagaccagcctgggcaacatggcaaaaccccatctctacaaaaaatagaaaaattaaccaggtttggaggtgtgcccctatggtcccagctattcgggaggctgaggtgggaggattgattgatcccaggaggttgaggctgcagtgagccgtgatcatgccactgcacttcagcctgggcaacagagtgagactctgtctcaagaaaaaaaaaaaatacaaaacacaaaaatagagaattaccatcaggcagagatcacaatcataaatactgcacggacacaaatgcactgatagatgctaaaattagtaggtgaaagtctgaggagagagagcattgcatagtctcaaagtatctccccaggataccagcttactagagggaaaataataaatttataagaaaactcttcagacaccaagttaactgagtgattggggtaaatatcaccagtaataagatgtatggtatcataaattctttgatattatccattgagaaggatccaccatattttttgtggaattgccaaaaatgcataacttcattccaatcataaaacactggagaaacccaaagggaaggacgttctactaaataattgatcaggattcttcataagtgtcaaggtaatgaaaaagaaaagactgagaaactcttatagactagaggagaccaaagagaaataacaactaaatgtgaggtgggatcttggatgaaatcctacatagaaaaagcatattaataggagaattggtaaaatttaaataacatctacattttaattaacaatatttaattaacgttagtttcctgtttaagataacttataatatgtgagatgcccacattagttgacatagtgaggaatataagggaactctgtactatttttgcaacttttttgtaagtcttacattagttcaaaacagagtttttaaaagagctgtatacgatcatctcaataggtacaaagaaagcttttgataaaattcaacacctgttcattaggaatagaataaaattttccttaacttcataaagagtgtctttagaaaacccagaacaattatcatcctaattggaaaaatattagaagcattccttttaaaattcaggaatatgactaggatactactattactacttttcttcaacaccatattagagttattaaccagtgcaataaacatggaaaaatagatatgtaaagattggaaaggtagaaataaaactgccattattatagatggtttacataccttttccctctgaaaactacaaacaaattattagaaataatgtgaaaatttagcaaagtagctggatataagattaacatacaaaagtcaatcacatttctagagtagagcgactaacaataacaaaggaagctgccattgacaacaatattattttgtactaatagtaataaatgtagcaaagtatgtgcaagacctaaaaaaggaaaaatttttaaatgaagaaaaactaacaaagaatgaaataaacatatactttattcattaattggaagatttaacattgtgaagatttcagttcttttcaagttgatttgtaaattcagcgcatgttcaataaaaatcctcgtaagatttcaagggcgcagtggctcatgcctgtaatgccagcactttgggaggccaaggtaggaggatctcttgaggcaatgagttaaagaccaataagattttcatgtaatttgataagattgtatgatatttatgtagaagagtaagtggttgaaaacagcagggcattttaagaagaaaagcagggaagaataatttaccctatcagctatcaagacttagtatgaacctatagtaactgagatggtgtggttttgcccagttgaagtcagttaaattttaattttgagatttctgtaaaagatacaagtttagtcttttattatgtatatttgaaggtgttacattttggaaagtgtgtgtgtatgaatgatagctaaatggcttctaagtaaaattcagcatatcttgtagatgttgatagaatagaaggggaaggaatgttttgaaataatgaaaataacatggtatgcaaatgctttgcaagagatttgggaaatgtagatatctctggttttaaggatgatctagattcaagtaatagttcagtaatttcataaaactcttatgacaaaattctggatggagaatattctatgaatcccctagagagtttcaggtttttgtagaatgatgtgaaaaatcttgaactaattagataatctttagaagttacttcacaatctttgtttttacacatacacaggaatttatggtgctttattttttacaggttagtagctaaataaagtatattctaaagtttttttattgatgtagggaaatggctaccagtggacattttgagaatattgcagttgtttttcttctgaaagagtaaaccgggtcatgacgcagcgagtttcagtcgtgacttttctgggggcatcgcggcgtcccctttttttgcctttaaagtaaaacgtcgccccgacgcaccccccgcgtatttcggggggcggaggcggcgggccacggcgcgaagaggggcggtgctgacgccggccggtcacgtgggcgtgttgtgggggggaggggcgccgccgcgcggtcggttccgggcggttgggagcgcacgagctagcgagcgagaggcagccgcgcccgccgccgcccctgctctgtatgccgctctctcccggcgcggccgccgccgatcacagcagcaggagccgccgccgccgcggttgatgtggttgggccggggctgaggaggccgccaagatgccgcagtcaaagtcccggaagatcgcgatcctgggctaccggtctgtggggaaatcctcattgacgattcaatttgttgaaggccaatttgtggactcctacgatccaaccatagaaaacacttttacaaagttgatcacagtaaatggacaagaatatcatctttaacttgtagacacagccgggcaagatgaatattctatctttcctcagacatactccatagatattaatggctatattcttgtgtattctgttacatcaatcaaaagttttgaagtgattaaagttatccatggcaaattgttggatatggtggggaaagtacaaatacctattatgttggttggaaataagaaagacctgcatatggaaagggtgatcagttatgaagaagggaaagctttggcagaatcttggaatgcagcttttttggaatcttctgctaaagaaaatcagactgctgttgatgtttttcgaaggatgattttggaggcagaaaaaatggacggggcagcttcacaaggcaagtcttcatgctcggtgatgtgattctgctgcaaagcccgaggacactgggaatatattctagctgaagaagcaaactgcccgttctccttggagataaactatgcttcttttttcttctgttaacctgaaagatatcatttgggtcagagctcccctcccttcagattatgttaactctgagtctgtccaaatgagttcacttccattttcaaattttaagcaatcatattttcaatttatatattgtatttcttaatattatgaccaagaattttattggcattaatttttcagtgtagtttgttgtttaaaataatgtaatcatcaaaatgatgcatattgttacactactattaactaggcttcaatatatcagtgtttatttcattgtgttaaatgtatacttgcaaataaaatagctgcaaacctcaaaaaaacaaaaaaacaaaacaaaaaaaaagagtaaaccaatttggttactcattttaccaatttggttttgattttgcaagtggttacaactcatgagaggattcttatttctgatcaatatattgtgtttttggaaaggacttctgggaaataattatgatgaagccctcgagcaattgcaacaaaaccaaaaattgaaaagtgggacctaataatacttttttaaaatttattttttagagacaggatctcactgttacccaggctggagtgcagtggtctgatcatagctcactgcagcctcaatctcccaggctcaagagattcttctacctcagcctcctgaatagctgggactacaggtgcatgcccccatgcccagctaatttttgtattttttgtagagaccaggttgtgtcatgttgcccaagctggccttgaattcctgagctcaagcgatcctcttgtcttagcctcccaaagtgctggaattacatgtgtgagccaccactcccagccccagaacaactattattaaaaagtcaaaaaacgacagatgttggtaggctgtgtagaaaaggaaatgcttgtacactgttggtgggaatgtaaattagttcagccgctgttgaaaacagtttggggttttctcaaagaagttaaaactgaactatgatttgacccagcaattccattactaggtatatatccaaaagaaaacaaattgttctaccaaaaagacataagcacttgaatattcattgtagcactattcacagtagcaaagtcatgcaatcaacctaggtggccatcagtggaggattgaataaagaaaatgtggtacatatacaccatggaattctacgcagccataaaaaggaatgaaatcaggatggtgcggtggctcatgcctgtaattcccacactttgacaggctgaggcaggcagattgcttgagtccaggagtttgagaccagcctgggcaaggtggcaaaaccctgtctctacaaaaaatacaaaaaaattagctaggtgtggtggtgcacacctgtggccccagctatttgggaggctgaagtgggaggatcacctgagcccaggaggtggagtttacagtgagctgagattgtgccactgcattccagcctgggcaacagagtgacaccttgtctcaaaaaaataaataaataaataaataaattgcagcaacacagatgcagttggaagcaattatcctaagtgaattgagggaggaacaggaaaccaaataacgtgtattctcacttataagtgggagctaaacactggctactcatggacatagaggtggcaacaatacacactggggactactagagggagagggttgaaaaactacctgttgggtactgtgctcagtacctgggtgacaggatcacttgtaccccaaagttcagtatcacgcagtattcccaggtaacagacctgcacatgtacacccgaatctaaagtaaaagttgaaaagaaaagacttctgtactttcatctttatagtgaggtgttacatgttttacaaacctagttctgataatgtgacaggaatataaatttatcttgaatattattaaatatataagtcaaagatcaacacagtgtttccatgaggtagactttttttggaatctaaataaccatgtgtttccacgtaaatttttatgaatcagggacaaatatataatttgatgtcagagatgtttttgttccccaaaagctctatcttgttcatgaaaaacgaagcccagagaagttatgtacaagttcacagagctcattattgacaaaaccagaatttgaatacaactcttctgattccagatttgctggaaatactgtgaaagaagaattcagtctggtagtattacgtgtggttttaattttttctttgtaactttagtttgaattttatgtgtgtgtgagcatctgcatttacttttaaaaacttttattgtaaaagccttcaaacatatacaaaagtagagaatacaaagcataatgaacttaagtacctattagccagcttattaaaacatggtcagtcttgtttcacctgttacatcccttttcttttactgtctaaaggaaggaaagaagaatcacaaatcagtttatgaagtctgctttctaaaaagtacttaagtgtttattgccaatatcttattttggtcggcaatcaatcacatactcaagcatacttctcttaccttcagagaaattaaaatttaatcagcaaaactcatcagcctgtacatttaaaatatatgcatgttattgtacagaaactataccttaataaaaagtgagaaaaaaaatgagacaggaaagagaaaaacatttaaaagacatagtaactgaagaattaaataaccaatccaacacttgaaaaatattacaatgtagcacatgcttaaaagctctctgagctcagggaaaaaagcagcactgtgaatctatagtggtcatcattctatgtggtattgggtaggacaagaagacagccttgcagctggaaattggtgaggacggaggcctcgtgtggaaagagtaaggcacactcagggagagaaccagtgaggtggctctgagcctgtttcagaaggggcttgaggaagaacggcagaggctaggatagttgggaaagcaggatcaaatcagactccagggattggggaaccaattggctgttacagggtggtggagtcaaaaaagaacagaaattttgtgtttggttaattgatagaaaatgatattattaacaaagtaaagaagtatgggaacagcacaagttttttggggatagtaaataattccatttccattgattaaaaatatcaagtttatttttacatctaaactgattcaagacttagctattgtacatgttttagagaaaacaaaactatattttatatctaatcatactttacaacataaaatacagttctaaaaaatattatttgtcaagaaaaatataatgttgccatcttttgtctgtatgcatgttttttttccttagattccagcgtagttagtgacgttgtacttcaagacttactggcatatgtgtcctcaaaacattcctacctcagagatcttcctccgagacagcctcagagggtgaacagtatagactttgtagaattggagcaccttcaacctgatgtgttagtccacgcagtactaagagttgttgatttcctatactgacaggtaaacattttgactgcctccttaattttagattatgaaaaaattaagatacaagaccatcttagtgtaccatttggttatcactatatatgtatcatcagctattaaagtatggtatcatgtgtgatagagtaatgccaactaagatactcattttccttttccagaggcagtatacagttatagaggacagaagcagaaaaaagttatgttaacagtggaacaggcccaagatcaacattatgcgcttgtattatggggtcctggagcagcctggtaccctcaacttcaaaggaaaaaaggtaaatacaccaaaaagcatttaacctatttatatttcggtaaatgattaatgtttatgagcccaagatggagaaaatcttaagagacgagacagcatttgaaatacaagtgatcatgattgaatattcttctgcaaatttcttctgttaaaattttgtacctcttgtagcaattcatttatctaataagtcttcattaattaatggtggtgaaataaaggcttaaatttattcccagatatactactttacctttttagtgaagatcttacctccttcaaataatgttctttaaacatttaattctggagaagcttctacaattttttttcagccagagtactctgataaataaatgctatgattataaggcagatgtcaagggagttaccttaactctttcaagtcacaattaatgttcaataaattacagtttcatatttttattatagttgttttaaaagcatgcactgttagccatccctagaatgttcagtgttaaaatatgacccatgattacatttttctttaaagcataaattatttctggtatattgaattaaatggaattgatgtttcattaaaatagtatagtgtcttccctttgctattgtgagatcctttagttgtaacaatcaaagacagtttcatttgtggcttatgagttatttttccctgctaaattaatttagagattgattcagtatattattattttttacctgaaagagttaatgtctctccaaacttctgccttccaaatagttatttgtagataggatctatcacattgtctctcttaatcattaatagctatgactaggatttgagataagtctaactttggacttttatgttaagatcaaacagggacagatgtttgtttggttgagcaagctgacaaacatgtatcagtgatagactaactatgatcattgaccaccatagcctggctgagaacatgagtctagtgcatgctacacaagaatgtaggtcacaggtatagtggagctgtaacagagcagattgctccatgtttaatgtgaatattcttttaaaattaatagttttttggttaatagaagagaaattacagttgtctctaggtgactctatggtgtttaggttagtattgaaaacgtatgaatccaggaattaagatgttgttgttctttgtacattcattcatccagccccccttatttgtaaccatcattttaaagttttaacatctacttcaatacctcacatcagtctttttaagataaaaataccaattttgaaggattacttaagtaattctattttcctgattttacttttcttttcaagagaccaaccccatttccaaattcccagcaaagagaatctgattgcccagagtaaatttgattcaaaaaactgtgatcaggaagacagggtcacgcaatacaaatatgagagcttgagcttatttcagtggatgggaaaacagttaagggaatcatttgtgatctgggtgaatacataaagatattcactaccaaaaatgtgtatgttcattagcttagaaagatatatgtaatgtattatttagtttaaaaagtagattataggccaggtgtggtggctcactcctgttaacccagtaccttgggaggctgaggtgggtggattgcttgagcccaggagtccaagttctcatcttaaaaaaaaataaaaaataaaaaaaattggattgtaaaacttcatgtatagaaaatatattatgttatcatataataaatatttttatgtttatataagttaatacacaaaaattttcaagaaaaccctttatatatgatagtatctcattttaataaaaatgtatctataagtacatatgtgcatttgaaaacctggaaatatgcatgtatagcaaaatgctagccgtagttatttctgtatagtagtattatatgtgctttaatttttttctttatacctttagtttgaatttcatatgtgtgtgagcatctgcatttacttttaaaaacttttattataaaagccttcaagcatatacaaaagtagagagaatactaagcataaggcactttttttttttgtttgtttgagacagagtttcattcttgtcacccaggctggaatgtagtggcatgatctctgctcactgcaacctccacctcctgggttcaagttattctcctgcctcagcctcccaagtaactggaattacaggcatgtgccatcatgcccagcttatttttgtatttttagtagagacgaggtttcaccatgttggccaggctggtctcaaactcctgatctcaggtgattcacccgcctcagcctcccaaagtgctgggattataggcatgagccagccaccgcacccggccagcataatgaacttcggtacctattagccagcttattaaaacatggtcagtcttgtttcacctgttacctccctcatctttactgtttaaatatttcacaataaatgtattttattttataattaaaaataaaattaaaaccttatgctttttaaaataaaagaatagttaatgtttggaaaatctagctaacaatgtgagaaaaaatagaattaaatttatactttatatttgtgccaatataaatttcagatacattagagattcaaatacaaaaataatgaaacaatgaatagtagaagaaaatataggcaaaattatttgtaatgcaaaggttggtagggtaaataaaatccaggaacaaaaactattatacataaaaaccaccatgtacaaaattgaaaggcaacaaaaaaaaaacagaaaaaaaattacattgtcagacaataatgcagtaagcaaaagacacatatctatagagttaaatggggaaaggatatgagtaggcaagtccccaaagaagaaataaaaatggccaataaatatatggaaaaattgttcttacaagtaattgaaaacacacaaagtaatgatgatagattatttttcttttaagaaattgattgagaagatatgggaaaacagctactgtcatcagctattggaaatgcaaactggcagaacctttcttgaggataactgacaattaatatgaacaaattgggggtacttttagcccaataattttagctctaggaacttatcataactatgtataaagatgtagctgaaaatgggtttatcatggtatcatgtataattgtgaaaaataaaaaacaaccagagtccctcaaaatagaggtttgctgtaataatttttaagattttggtgtatctggacaatggcatattatgtaatatttaaaagcaatgtagaataatacatacatataaaactatatttgacttattaagtcaatcccaataaataaaatcccaaacaactggttgtccgctaaaatgttaactgcttatttagggtgttgagattatggctgctatatgtttatttacttggcttctcttagcttacttttctaatcaggtattttgtaataagacaagaaagctattttagtgattggttttaagcagtaacttggaatatatgctttagttctagctagtgatgttctgtctttacagatttactgagatgtttgatgattttccaccaaaaaaaaaaaaaaaatctttagtgaaagaaactaaggagatgagcaggtgtagtaaattagatttatggcctgaagtgagaaactaaaaagacagctgatgttatcagaaaaatgagtgctaagaaaccctcttttgttttattatagttttgaagttgaatttactaatacagaatatgataatacagataagttgaatttactaatagagaatataacagtaacaaggtctgtgttactgtggctttaagtattagaattgtggccggcgcggtggctcccgcctgtaatcccagcactttgggaagccgaggcgggcggatcacgaggtcaggagatggagaccatcctggctaacacagtgaaaccccgtctctactaaaaatgcaaaaaaaattagccgggcgtggtggcaggcgcctgtagtcccagctactccggaggctgaggcaggagaatggcttgaacccgggacgtggagcttgcagtgagccgagattgcgccactgtgctccagcctgggcaacagagcgagactccgtctcaaaaaaaaaaaaaaattgttactgagagttaaaaataagtactattgtgtctaaatgctttttgttctagaaaagttaactaagataactaaagtattgaaatatgagtgaaatattagacttgggttcatttcagtgtcctttctttaacaaaacaaaacaaaactttgcctatagatagatacatgagaattttctttacagaaagcagttggttattataaatgatgaccgttcaggagggcaaggaatctttagaaaatattttattaaaattatctctggtggcccggcgcggaggcttatgcctgtaatcccagcactgtgggaggccgaggtgggcggatcatgaggtcaggagttcaagaccagcctgaccaacatggcgaaaccctgtctctactaaaaatacaaaaattagccgggagtggtggcacgcacctgtaatcccagctactcaggaggccgaggcaggagaatcacttgaacctgggaggtggaggtttcagtgagccgagatcacaccactgctctccagcctgggcaacagagcgagactctgtcttggaaaaaaaaaataataataataatctctagcatgcttctgttgtcttaatgcaccattcatattttgtctctgtttacccaaattctttagtgataaaagattagtattcaactgacttaatcagatcaatctatttaatctgatactaagcctagatttttttttcctttttggtgacttttgtttttactgtttttgtttaaggttatatttgggaatttaaatatctttttgttcagcgcaattacacactagaaaacctagaattgcatacaacgccttggtcatcctgtgagtgcttgtttgatgatgatataagggcaattacatttaaagcaaaatttcaaaaaagtgcaccctcctttgtgaagatatcagacttagcaacccacctagaggataagtgttcaggtaagatttttatatacataaattctgctatttttatttcttttgaaacagagtcttgctctgttgctcaggctggaatacagtggtgtgaacacagctcactgcagtctccacctcccaggtttaagtgattctccccgctcagcctttcgggtagctgaggagggaagggaaggctagtgcataccatcagtgcatgccaccacacccagctatttatttatttattattttggcagagacagagtctccctatgttgcccagtctggtctcaaactcctggactcaagtgatcctcttgccttggactcccaaagtgctggaattacaggcatgagccaccacacccagcccactgctagttttaatataagcaaaaaggctaccacttgtggtaaaaatgtataagtctatataaaagtgaaatataaatctttgcaaatatctgaactagattccagtagttttaggaactatgtgctaggaaccagggacaaagagcaaatacctattttttattatatgacaagtgggagcagaaattcagatccttactttatcttggccaaatgccagattaaaatgttactagttgggttaattcacatatatgtgtaaatatgttttccaatatatgattgaaggttagcattgttatatcataaaactatgctaaggagaatacaggcagaaaacaaagacaatacctctcaaaaaacccaacttttaattgaatacagagatttcattctcagagaagaactccttattcttagttctacactgaaacatttactaataccagcagatagtttaaattaataatatttctggaaggtaaacacagatgatagaaaatttataagcttttatactataaaaatttcatactattttcaaaaatggaagttgcctatggtcataaaagactctagatttatactaactggtaaaatcttggtaatgttatagcatcatgtaagttcctaagccagttttatatttatgtgcccctcccgtgctctgcttctccaacttcacagacatatagaggtggtcaccacaggaaggaatgccagacacagttgaggggctaccttactttgcagagacgtttagtttggtgccatggagaagtcaactctgttatttactgcttacacaaaacagttatctgctgggattgaagtctagaattaggtttaaaaataaaaataaataacatcatggacaacaacaaaataggaggccaccacgctgatgatgaaagattctcaggctatagccccacttgtttgaggacgcagccaggaattgtgcatgttcttggaagtcctggaggtgtgctcctcattagcaagccatgccaaaactgtgccattaaaatcagtccttcagaggctttgttcacagaggcctgtttagcctttttcattctctttatgttcagctatgagggctgaattcatagtttctgtcatagtgtatgtgtttttaagacaaaaatggagagagaatatgaaaacacaagcaacttttccctaacctattttatagttaaataaaaggagaaagagagatcagcatgggagcatttcctagaagggtctgcttgctcaacaaaagccagagggggatgaggctaggcctgagtccttgtaaagaaatgaagacgcttacccagtacctcatcttaccgccagcagaatttcagtgctcagccggagtgacccccttgaaagcaaagtccacattcagcgtgaccttttaattcttttcaagagttgtgtaaatttacaaaatgataggattatgtgaacattcttttaaaattattgaattattacgaattttttaggctgggcagggtggctcatgcctataattccagcactttgggaggccgaggtgggtggatcatttgaggtcaggagtttgagaccagcctggccaacgtggtgaaaccctgcctctactaaaaatacaaaacttagccaggcatgatgtcgggtgcctgtagtcccagctacttgggaggctgaggcaggaaaattgcttgaacgcaggaggcagaggttgcagtgagccgagattgcaccactgcagtgcagactgggtgacagagcaatactctgtctcaaaaaaaaaaaaaaaaaaaagactttttgagtggagggaggagagcaagggttgaaaaactaactgttgggtactctgcctactacaggagactacttgggtgatgatatgcccatgtaacaaacctgcacatctaccctctgaatctaaaataaaaatcgaaattttttttttacatatttttttaggccagacacattggctcaagcctgtaatcccagcattctgggaggccaagaagagtggatcacttgagcccaggagttggagaccagcctggtcaacatggcaaatccccatctccacaaaaaaatacaaaaattagccaggtgtggtggtgtgtgcctgtagtcccagctactcaggaagctgaggtgggaggatcacttgtgcccagggaggttgagactgcagtgagtcaagattgcaccactgcactctagcctggacgacagagtgagactgtctcaaaacaacaaaaaataataattttgtagtgatttaacatgtctttggaaagatgtggtattgaatcttctacagtttgttacatattcgatcgctacgcactcctgctaactcatgtagggatatgtgacacaattggaagagatgatgaaaccgtctttgggcattgaaagactaaagcaaatgaagttaagaacagaagactcatcattaactggactctgaaagagataaccagaaaacagtaggagactagagtgattagttcttgacctggagtgttcttacttctaagtggatgaagaagaacaaatttgaaggcttaaggcttaaagaagcctttaaattgactatggagaaagggagaataatgctcaagaaaactcatagacctcaccagtacacagtaagacaaaagtaaattaggaaaaaataatgtctgggagatagtagactttcagtatttgtttactggtgaatggatgagccattagcagtgaattatgaatatgcttgaggtttcttgtgagtcacctgagaaacgattaataaatgagaactttttataacccacagccagagtatatagatgataatggtgagcggaaagttggaaaaaagtttaaaagagaacaggctattgatatttttacgtagagagaagaagaaaagttcacctcctatttggcttttttttttttttttttttgagacggagtctcgctctttcgcccaggccggtgtgcagtggtgtgatcttggctcactataagctctgcctcctgggttcaagccattctcctgcctcagcctcccgagtagctgagactacaggcgccagccaccgcgcccggctaattttttgtatttttagtagagacagggtttcaccatgttagccaggatggtctcgatctcctgacctcgtgatctgcccgcgtcggcctcccaaagtgctgggattacaggtgtgagccactgtgcccggcccctatctggcttttcaccatgatcagtttaaaagaagacagggcaaggagagagggcatgttagctagtttcaagtattcgaagggatttcttctaaaggaggtattgaacttattttgcctgattccagaggatggggaaggaaggaaacatcacatgttcagccaaattagccaagtaaacctgctctcagttgcagccagacctccctgcccttagattctaggaaaatagtaaagaagacgaagaacaagacctcagtgtatccttttactacaagtgactgtaaatcaactataaaattagccatgtttgtaaattaaagttataattttggcccaataatttataacatatctgtttgttgtttgtaggagtggttctaattaaagcccagatttcagagctggcatttcctcttacagcagctcagaagatagctctaaatgctcacagttctctgaagagtattttttcttctcttcccaacatcatatatactggctgtgcaaaatgtggattggaactagaaacagatgagaacaggatctacaaacaatgttttagctgcttgccatttactatgaagaaaatatattataggtaaggcaactaagcaagccaatttgatggaaaataattattatagatctggaaaaactagtctgtaaactcttactttctaaaaagaattaactagagctagtcgaagagaacaaaattttccctgagtgatagatagctatttatggtagcaaaaattacccaggaatcgttataggaatttcttaaagataggaatttcttaaagcagtaattgggagattttattgtcttcaaacagctgtaccaaagaaacattttccttggtttactttttaaccaaaatctaaatgctcataaataactcattttcccaccttaacatataattagaatttaaaggctaaaagtaccatatgatgtcacctctgagttgttgtggaagctagtaagacatttaagctgttttcccacctttaccttagaaattaaagctagcaaataaatgttatatggtaaaactgctaatcagctcagtgaaaaacacattgttttttgaataataggtagtcaaaagctcagacatttttctctttaccttataaattacatgtgtttacaaaatagcactcagtgttttatgctccttatgattatttctaaatattgcggtatctaaaaactaaattcagatatattccacatgttatcatggcatacttcaagaaaagttatagaagcttaatttgtaaaccttatttctctttacagatattatgtttgttataaataagtgaatgaattttgctattactgtgaaagttgcttttgtggaaaagaagattgaattaagatgtatggtaggctgggtgtggtggctcatgcctgtaatcccagcactttgggaggctgtggtggggggatcgctggagcccaggggttcaagaccagcctgggaaacacagggaaaccccatctctaccaaaaaaaaaaaaaaaaagctgggcatggtgacataggcctgtagtcccagctacttgggaggctgaggcgggaggattgtttgagcccaggagatcgattgttacagtgagctatgtttgcaccactgcactctagcttgtgcaacagagtgagaccctgtctcaaaatcaaaacaaaaaatgcatggtatgtaacaaacaacattgatttattaatagttaaggcccctcaaaagtatgtataggtgacttatttatatcattccaaatgtttctattcaacataagcatttattggacaaaaatgttgctcaatactattccttatggggaggagggcctttgaatctttagtttacaaaatgactgttcaagagaaggacttcacagatcagtatcacctgattatggcataactagtatggggtatttaagatctcttcctaaactataccacattaaagatgtagtgctagtttgttgtcttactagaatgttgaatggtcatgttaaggcaagaattattattttttatttatttaaaagcctttttttttatttttttgagacagagtttcgctcttgttgcccaggctggagtgcactggtgcgatctcagctcatcgcaacctctgcctcccaggttcaagtgattcttctgtctcagcctcccaagtagctgggattacaggcatgtgccaccacgcctggctaattttgtatttttatagagacagggtttctccatgttggtcaggctggtctcgaactcctgacctcaggtgatccacccgtctcagcctcccaaagtgctggaattacaggtgtgagccaccaagcccagcctaaaagcctttaaattattagagtccagattatgtggtttccttggaaagaaaatattgaaattaacaaactcccttcaagttatcaagtatgtgactccaaaatcatctacataaatcaatcagcaaactgaataagagaaaactctcattgattatttttctaagactcagtcaaatatttattaggaatccacgtatgttcacatatcacatgtgtactgtggatgttatactagttgatctaagtagacttattgtgcccaagaagcttggtagtccatttaagaaacacttaatgaacatttgtgtggcacaacagtcccaaactatgagtgggttgatcatattttacattggttgtaacttggagctgattttccaatggaagcaacattagatattgcaatggagtctcatacgaggccacagacatttattaaattaacatgtagatagcatagttcctgctcttcaagctatcataaaactcaaataccatttttaacaatgtttctacagaatattcagatttacatttttggaatacaagaaatacatttatttttctgtactggaagcaaaaaaccccagcaggtcaaaccacaattaaggctcctatttaggcagcactaggaaatgtttgggtctctcaagaggttgtagtcaaggtgtaggctggggctgcagtcatctgaaggcttgactggggctggaggattcatttccaaagtggctcattcatatggctggcaagttgagttcctcttcacttgggtgtctccacgggctgcctgaatgttctcacaaagtggcagctcatttcctcagagcaggaaaggcaagaaagagagttccaggtggaagccagcctttttgtgacctagactcagaagtcatgtggcatcacttctaccaaattctgttcatcagaagtgagtttagctgtgcgttggagagtggattagaatgaagctagtgcagagaagcggtaagaggctgttgccttattttggagaggagatgatggtggcttgactagagaggaagcggtaggaataaaaagaagtggacagatttgagaatggtcagaaaatagtttgcaagatgtagtgattggtaggtaaagagagagcacaggtacattgcaaatcattgacagttgggtgaacaataagattatttattaaaacaagtaaccttgggagaaatcttgatcatattgagcttgagttcctgagaggtaacaagttggaaagtggttagatgtaaagaaatgcaatttgcaagagaagtctgggctaggcttataaggttatctgtggtgattgaacttttccttggtttctgcaccctgttttgtttttccttcttaatcttcagtgattacctctcataatggattattcttactagcctataaagacagtcccatatttctcttattaaaaaacaaacaaaatcatccattaacattacatctccctcttatcccttcgtttttctattctgttttatacccagccaaactttgttaaagagttgtaaatatactctctctcccctattatgtcttcagtttcacttcagttattccattctactcctaccatgctgcagaagctgcttttgtcaaagttacacttttgatgttgcctgaggcatggatacttctttcctcgctctaactgctctcagttatattcagcatgtcagtccacttcctccttcttgaaacagcctcctccttgctttctaacctgtctctcaggcccttctttctcagccttttctaccccctctttaaatgctctcgtctgtgtccttcctcttattctttctgtacattctgcctggatgatcacagctgttttcgtatttgtacttaacatcttcaccctgattttctcctccaggctccagtagtcaggtatcaaattctttgcttgatgtccatctcacatttaaacatacccacaatagactcttgtttttcctaaaaccacactcaaatctagttctcttcgtttttatactttctggaaaatggcacaccatctacccaattatttaggctggaaacctgggcacaatcgttgcatcattttctcttccctacctcccctatctaatctattagcaagtcctaggaattttcattcagaactatatcacaaattcatccacttttttccatctccactgctaacatcttagtccagtgtatcccagcaggggcattgttgacatttttctcaggacagtttctcattatgtaccatatcccacatgctgcggggcatgtggcatccctgtttaccttcccctagctgaacctcaattactgtgaaaccaaaatggaaagtcagtgcctgctggtctggaatcactcaggcctcatctgagtccctactacctgttgcgcaaaccagcacaccagcagtctcttggtggggctcctcctggccttgcctcctcccctttattctccacccgttggcagtgtgattaccctttgcttcacccatcagtcatctccttatgcttgtttcctctgcagtctcatctgctgccactcccctgttgtccagcactctagccacgtggccttctttcagttcttcagacattttgatttttctccttaggatgttctcgaatgtcttccctctgactccacaaggctggtttcttcatgtcttagattaaatgctgctttatcagagaggcctctcctaaccacccttctttattttctgttatagtagcctgggtgtgcttactgtaatttgtatttgcatactgtcttttctaaaaaacatttttactgaagttaaaattcatataccatcaaattaatcttctgaaatgtacaattcaatggcggtagtatattccaagggctgtgtagctatcaccacaaccagttaggacattttcattacccagccctttacaaagcctcatactcattagcagtcactctccattccccatgcccctcaacccatggcaactacgaatctgctttctgtctctatagatttgcctgttctagatattttatataaatattatataatatgtgatcttttgtgactggcttcacttagcatgatgttttcaaggtccatccatgttgtagcatgtatcactacttcattcctttttattgcaaaataatattttattgtatgcacataccacattttatttatccattcatcagttgatggacaattgggttgtttctactctttggctattatgaatgatgctgctgtgaacatttgtgtacaagtttttgtgtggatatgtgtgttcatttctcttgggtatatatctaggagtggtggaattgctgggtcatatggtaactgtctgtttaaccttttgaggaactaccaggctgttttccaaaattgctgcacaattttacattctcatcagcaatatgagggttgtaatttccccatattcttgccagtacttcttattccgtttttctttttgttgcatgtgctttcgggtcatatctaagaaaggtgtcatttctaagccaaggttatggagatttgctcccgtattttcttctaagagtttagtagttttacctcctacatttaggtttattatctactttgagttaagttttgtatatgggataaggaaggggtataattttattttttggcatgtggatatctagttgtcccagcgtgaatttttgaaaagactgttccatccctgtttagtcatcttggcaccactgttgaaaagcttattttctttcttcttctttttgtagagatgaggtctcgttgtgttgcccaggctggtctcaaactcctggcctcaagcagtcctcctcaccttggcatcccaaagcgctgggattacaggcatgagccaccgcgcatgcccaatttcttcctatccctctacagttttacgttccttgagtgacggaaccagatttgtctttttcactagtgggtacccagcacttaccacagtccatgatagatactcagtttgtatttgttgaaataaataatggagggagagagaggctgaggaaagagtgtagagtgaaaagaggaaggaacatagagtcatcgtgtgaataaagggggaagtgggtttttagggggaaaatcagtagttatgttttagctctgttacattaaattcccccgctaatgagcctgtttctgaattctgttctcaatttattttttaaaaatcaatgtagttataaaataggtaccacatgccatggttaaaatgcacactacataggaggttataaaacaaagagtgaaagtctccttcaccatccaaccctctcccaccagtgctgcttccatgctggtgagaaggttttttgtatgtccttccagtgatttattatgttcatcccagcacatgtgtatccctttctttagaagcatgtggacagaagaatattgttcatattgttgttccctagagtctatcctggtgctccttccctaatagcacttgcaaatgttcttcattctttttatcagctacatagcattaagatgtaggatgcactgaaaattgttaatccagttttattgatatgcaaaacagtttatttctgataggaaagaattcagttgaaaaaagtaacttgaaattgtgattgtgaaatatgtgattattatttttattttcatttctaaaaacaatttataaaacagtttaatatatttttatattagtatctgaaatttaaaaatggatatagaataaataaaatgtagtaatttatcatttgaagctcttggggaaaaaaaaacctttttttccttctaggatgtcacagaacatcctagagttgttttaagcattaaaattaatcctgcattaaaaaccaagtgctttttggaattatttttcatttaaacatttcttttatttgaaaatctttttgaaggtcgtgtgttgtttactcttctgtaggccagcgttaatgactgccgttgatggaagacataatgtttacatccgtgtagaatcaaaactgatagagaagattcttctcaacatttctgcacactgcctcaacagagtgataggcaatatatcagtgtgccatcaagaagttgttttattcaggagtataaatggtatatcggaacagaaagagcactctactttaaattaagagcttttctgtccatatgaaaacagaaggataatttagcttaagtgaaatataagcctatgtaagttagaaggttgacttgctttacacctgttagtacatgaacagtgggaggcacctaatttcttcttaacctacatttcctgttggtaagcaaaaactattttacttaactctagttttataagaatgaagtcaatgagtgtatgacataatatatatgaagatagtccagtgtcagtggaatggatttgcaagatcttcaaccatgatgtcttagttgtcagtggctaagaataaagcaaagataatatatttgtcaggtattcaaactccattcctgttctcattagcctcagatcctctaagctgatgagctaatctggttctgtgattgctttatctttcaatagtagattgtttttcgtgtttttttttagttgggggtgtctagtaattttgggttgaatgctgaacgttgcatatattaagtagaacagtacaaactgaggtaaatagtagttgtacctggaaacaggcatgcctcttctggtcctttactggaggtgaggggtgagcaggatggtcagccttgtcataagttgagttggattcaggttttgttgtttctctggttaccttcaggtcaccactggtttcaaattatcttgtgcttatggtgggaagtggttccccagtattcctgctccaccatcagcatagccctccactctgcacctgggcctcagagaaagtttctttccatattcttgcacctccccaagttgcacaagcttttgttggttgttatttggtgcatcctaacctggtgggtgggagcagggttgttcctctttgattctggtccagccccagtcttatacggatgttgcacatggcgctttcttggtagccctgtcccttatgtggcatggcagctgagctctgtcttgtgcctttagtgggtcttgtgtggtcctggccctgccccagcagtaggggaccactaatggtcttgacccagggtggtttttcagtcctcccccaggatggaggtttttttttttcttttttctttcccccatctgtactggttcctcacctgtaccctggggcaacaggatttggtgtccctcctccagcaattgaaggcttttgttccttaaaggggaggccagatggtgctttgtgttttgtagttggaagctttctctgatgtcttgccctgcccccagtcttatgagcacctggtggaggtgagacgtactatgtggaagagcctatgaggatgcagatgttccttatgttgctgacactggcagttcattggctttttgcaattaatttattaataaaaattaatcacattcttctttcctgcctgtatggaggacctgtcttcttcccaaggcctgccccaagggaacctgtgctcctgttccatctccctggaggcacctgtctccttatgtttcagtctttttggctgttttacaaccttggttctcatgtgtattcaagaaaatgatgattttatatttattcagttttttccagtaactgttagggtaggagccactttttccagctttctacatcttaattagaagcctctctccgttttttcccccattttctttatttcatttttattcttttggctattttcattccttttcttaatgttacttatatattttcagtgttatctcttctttttttttttgagatggagttttgctcttgttgcctagactggagtgctgtggcgcgatctcagttcaccataacctctgcctcctggattcaagcaagtctcctgcctcagtttcccaagtagctgggattacaggcttgtgccaccatgcccggctaattttgtatttttagtagatatggggtttctctatgttagtcaggctggtcttgaactcccaacctcaggtgatctgcctgcctcggtctcccaaagtgctgggattacaggcgtgagctgccgtgtccggcctatctcttcttttttgcataatgtaaattagtctttatctcttagagaagcataattctcatatcacatatacttcagtgttttgtccattcttgagacaattaaagttgtacttcttggcattaattagattgtgatcataagtcaaaatgtcattggtcataaagtggtcatcagaccatgcagactattactaatattggttatgttttagtttattgcagtgaaaatacaaaatttaaaagttattgtagagaattatcataccccccaaaatatgtcattggtcctccaggactctgtagtccccatccaagaaagactgtgataattgtcaaggggttagtacggtctgagcatggtcgatggtgctctgtcattctggtattgaacaacctcccaaatgtcttgattacatgtcctaaaaaagtgaggggaagagtgtaggacaaatgcaaaataaaataacacatttagctatacttttagtattttttattattgagattcaatatttaagtgaccgattcaagattcttttatataaaaaatgaatatatgcataagtaactgtgataagaactgtggatggataagagcactcgtctgatgtactgcagcataaccagaactgctgtcggtctgaacggtgtgttatctgggcctgtttcttgtgtcagggggatcacatgccgtcactctggagtgcctcaatagcttgtaactagaaagagaaggtatagaaagagtagtttacttacctgtttatttatttagaggcagagtcttgctctgttgcccaggctggagtgcagtggcacaatctcagctcattgcaacctctacctcctgggttcaagcaaatctcctgcctcagcttcccgagtagctgggattacaggcatgtgccaccactcccggctaatttttgtatttttagtagagacagggttttactgtgttggccaggcatgtctcgaactcctgacctcaagtaatccagccacctccgtctcccagagtgctgggattacaggtgtgagccaccgctactggccgggaggagaaatttaaaatgggtttgagacttgaggaaccaaaagaaacaatgaaaccattcaatgtgtgtgctcctgtcaagctagcagcgatcttgagagctctgtgttttcgtcttctgcagttccttcctcagagatcacctatgggatggttgtggcagacctgttccactccttgttggcagtcagcgcagaaccttgtgtattgaagattcagagcctttttgtgttagatgaaaacagctatccattacaacaagatttctccctcctggatttttatcctgacatggtaaagcatggagccaatgcccgtctctgaggccagaggaagaaattgcaggcatttcaaggaagaagtactgaaatgatttgtcttttgaaataaatgaatgacagggcttttgctttggattttttatgaaatatattttacaaagagaattgcactagataaattaaaacttttttctaagaaaatcctgtgaggtttaaaaagattgtttttgtcttttggtttcttcctttcttctggagaaatgatctaccagtcaaggcaatatgtagcagatccctgggaattaaaggtttgcccatttgttcactgtatttagtccctgctacattccaggcatcgtactaagtatggggaaccacagagaagacactccttcagaaactgctgcagtgctttcgcttatccctacctaaaaaaccgtcaatgtgaaatcatttccttgattataactataatgataatggattagtttatataaacctatgtttagacaagttcaagacaagcgtgtctttctataaaaagtattgaaagtgaaggaaatgagatcatgtttcaatttattaaagcagggaagagcgttctgtggttagttcgtgtctaggatttgagtgccttactgaatgtatttaccagcaaacatgtagcaatctgttctctcattgtgattgtggaagaagctcatgtaaaatgatagtcattaatgaggaagtatggcgtggtacttattctgtaagctcagagtatgctgagtgttaatagattgtcatattgcctgaaaataaattcatgatgacatgaacaagcttcttttaccctgtgtatgtttttaaaaattcctttggttcagaggtggttgttgttttttaacttggcttccctaagaacgaaccacaagagttttgtgattctttcaaaaataatatgccaaaatgcctttgtgggagcacacacacacaaatgcatgtttctgtggagaaggatccatagctttcaacaaatcctcagagggttctgtgaccaagaaaggtaagaacaaggctttaactgatgagtttctttgtggggtagataagggaattagagcaaatgattgccaaagttttgtctagcaactaataaggtgggtacagaaagaattgactccattttgtatctagagagactggaattcaaacaaaatcattggctcccttcaatgattcgttgaatgggtgatgaaacttgagcctgtagttgacgccttctaatctgtgctctctcaactataaccacactaggcagagatttggaattctgatataaaatctgcccagtcaatataggccaaccaagagagctgttcgcttaagtgtgcccttccccacttcgtcctcaagtggagacctaatccctacatcaaccagaacataatccccaggaagagatggctcttcacatcctattgggaagaaatctttaaaccatttcaggtgagtcaacagatcacaccaacatctcttcacagttgttggtatgtatttcattaattaacacatatttccaggagcccttatttaggttgggaactgtttcctccagtcctgaggaatctgagctatctacagaagttatgagctatttaagtgggatcaggatcagcccattgctcctgctatggtctgaatgtgtcctcccaaaattcttacgttgaaacctcatctctgatggcattcagaagtggggcatctgggaggtgattagatcatgagggctctgcccttgtgaatgggatcagtgcccttacgaaagtggcccgagggagcttctttgtccccttctgccacaggatacagccagaaggtgtcatctttgaagcagagagcaagccctcactagattctcaattttctggcaccttgatcatcccagccttcaaactgtaaaaaataagtttctgttacttataaattgcccagtctgttattttgttatagcacccagaacggactaagacaccttctgtgtgtattctttacctgagttgacaagtaagtgtctttattctgttatgttttcataaaactcagtggggtagccagagtgtcatccagcagtcccatatctggcagtcttatggtgggcatttcagggagacctcattcttcatcttctgttagttcagcttgcagggacagctctcctatttttagagaatcatttttatttgttagtcacttagtttccccagaggtatcctttttctaacagcgttagaggcattcacctttctccccactagtaagatctgtgctgtttcattttacatctttttttttttttttggttgggggaaagggggctgatcatcaaatgagttgacaacattgggtgcatgatccaccctgcagacgttcgctgaatgtctaccatgtgctaggcactggaaatgcaaagacacaaatgtctgccttctgtaagttcacaggcaagctggtgaagaaatatttaaacaaaattatatcagcgccaggattaaatctgtgtggaatacagagccaaggcaaaagaggtaacagtaggatgggtttgttagtcatgactcttggttgcaagtgataaaaacccaactcagagtagcttgagcaaaaaagggggacttgattgactcacataaatgagggtagtaccagcttaaggcacagttgaatccattggcctaaattacctggttaccccaactccctaatttttctttctttctttctttctttctttctttctttcttttctttttctttctttttctctctctctctttctttctttctttctttctttctttcttttttctttctctctccctctccctctctctctctctcatcagaagaggtcttttacgctgttattgcaaaagcatagatgtttctacagagttttgataggataacattttcacagtgattatgaatttacatcgtccctagaattctaaactactgggatctgaggccgtaagttgtttaagagtattctgacattaccttagattcagcaaaacttgaatagttgatcatgcctttcttagaagaaaatatctgtaatttctcagaacaatatagaatgagacagaaaaactaaccatccctatgtgccttattttaagtgatatatttgtatcctgatgggtttctaggtgttggaacacaggtcatgaatcatagaacaattagaataaagtgttcgtctttatcagtagcttaattctggcccttgatttaatgtcaacaggggagaaatgtgtgagaggggatgaggtttgccaattaattgtcattatgtctttggaggtcttgaacctgatttgttattaagaagtgaattctacccacttaaggcatacatttgctaaaggtgacctctctgcttccacgttgttaagaaatcgtgatttttttcaaaacaatcatcagctttacagtttttgaggaaagatctagaagcctgttaaaatggacttaccaggcagggttcagcccaggaaacacaagccactctgggtattctaaacagagagagattaatgtggaattcaggtgtttgcaaaggtattggaaggctggaggagcaggcatcagtctgagctccaggaggctgccacgtgaacggtggattcatgaaaacatcatcattggctgcaatcttagactgaggatgcagctgctggcatcccggcaactgactctcaagcacatggaagctgggagttatttgctgctgcccaaaactcagtccccacagctacacttgccaggaacagtagcttcaggaagatagcctggatttcactcatcttccatattgcacatgtgtgtgtgtttcattgatggaacatgattcacgctgagagctttagctgcaagaaagtttgggaaatatgtcttctctgaggcttttggtctttgcagttcaggagcagttaggaggtgggactggttggttgcagagtgagctgatttactgcacttagtctagcttattaaaggatgagcttataaacaccccaggtaatatcacaatacataagtgctacctaattactgtgtgggtctgttaccaagaatgtctaagtcaagaaattgaagattgtttccttcagattctgcatcctaatgtagaatctttcctattagagtataagtaaattattttggtgtgttatttaagaatatttgtgaataggcttaattaaacaccatgttaagaaattataaacttaaggccaggcacagtggctcacgcctataatcccagcactctgggaggctgaggcgggcagatcacttgaggtcaggagtttgagaccagcctggccaacatggtgaaacctcatctctactaaaaatacaaaagttagccaggcgtggtggtgcacacctgtaatcccagctacttgggaggctgaggcaggagaattgcttgaacctgggaggtggagcttgcagtgagctgagatcacgccagttcactctagcctgggtgacagagtgagactctgtttaaaaaaaaaaaaaattataaacttaaaaaaaaaatgttttcctttaaacaaaaacgcatgttccttgttttttgttttgttttgttttgccttttttgagagacagtcttgctctgtcacccaggctggagtacagtggcacaattatggctcactgtagcctctacctcctgggcgcaagcaatccttccacctcagcctccctggtagctgggactataagtgcagaccacaacaactgattttttattttttgtagagacagggtctccctacattgcccaggctggtcttgagctcctgggctcaaccgaccctcttgccttggcctcccaaagtgctaggactataggcgtgagccactgcaccaggccgtttctttttttttaaaactttggaaaatatggatgaatgaaagtgagaaaagtaacccttctgttattctaccaaccaaagctaattgctgccaacattttaatagatattccttcggttgttttatgcatgtatgattttgtacatgtgtctactttaaaatatatagtctttcaatgttgcccaggctggactcaaactcctgggctcaagtgatccatcacctcagcctcctgcatgtatctacatcttattttattttatttttagagacattctgttaaccaggttggagtgtagtggtgtgatcatggctcactgcagcctcagcctccctgggctcaagtgatcctcctgcctcagcctcctatgagtagctgggactacaggcatatgcctccatacctggatactttttgtattttttgtagagacatgtttttgccatgttgcccaggctggtctaaactcctggcctcaagtgatcccctttgcctcagcctcccaaagtgctgggattacaggtgtagactaccacgtctggccaacattctcattgatagtctttgcacacatctttcattccttctgggaatttattctaagaaaatagaattttggggtcaaagtacttgtatgtatgtatctgtaccaggaaaaaagcagaaattccagtatcaacagataacgagagccacgcagggtggtacatgcctgtagtcccagctactcaggaggctgaggcaggaggattgtgtggcatgagcccaggagttagaggctacagtgagctatgattgcaccactgtactccagcctgggcaatagagcaagaccctgtctctgaaaaaacaaaacaaaacagataaccattgttactattttgttgaacattttccagataccctgatagaagacagatctgtgcatgcacatacacaattttacataaatgggaccattccatataggccagtatctagtgtgtactttttttactccacaatttgccatatacgtctttccaaatcaatcaacatagattaaatcatatcaactacacaggattccatcatttgtgtgtgctcttgaatcctacttttaaaatgttctcagaaaggttatcctgaaatatattcctatcagaagttttccacactctctctaaactgaatggcataagtgaaagactagttgttaggtttaaaaaaggttatctgttttaattggaattttttttttgaggttttctttttcttttttctttttctttttttttgagacacagtttcactctgtcaccctggctggagtgcagtggtgcgatcttggctcactgcaacatctgcctcctgggttcaagcgattctcctgcctcagcctcctgagtagctgggattacaggtgtgcaccaccatgcccagctagtttttgtatttttagtagagacaggattttgccatgttggccaggctagtcttgaacttctggcctcaagtgatctgcctgcctcagcctcccaaagtactgagactacaggtgtgaaccactgttcccagccttaattgaattattttattgctaaagtgattgtacatttgcttcatatgcttatcagtcatttgcagtttgctttttcatattttaccttagaccatttttatgtgggagaagccttttattaaattagtatgttctccttataaagttagtaatttttaacatgtgttgcagacatttttcccaagcttgttatatatgtttgacatgcagaaatcataaatatttacgtggatcaacccatcaatctttttctttattgtttctagattttatggcatgcctagatagcttcttttctactataagattatacacattttcttcaaaaaattttttgaaacatttatgattgttatatttgtatttaaatctttaattatctaaaatttagtgcatggtatgaatggatctaactgattcattttcctaaaatggtcagctggttgtcccaacactattgatttctttctttcccatcagtgacatagatgtgatctttattataatatgaaattattattcctgctagcattacctgtggactttctggtctgtttcattgttctatatttattgctgagccagaaccatacagttagaattattataactttacatctgataggaaaagtacccctatatttttcttcattaaaattgtttttctcagacatctttgcccatctgttcttttttattccccattaagagtatatgttgcagtgttttttagtatattcagagtgtgtgaccatcagcacactcaattttggaacatttcatcacccccaaaagaatcatccatagttacattaactataccaccccacagctcttccttaagaggagctaacagtcgctcctccatacccaccccctttcccccaaccctaggtaaccactcttctacttagtggctgtatagatttcactattctgacatttcacatgaatggaatcatacaatatgtggtcctttgtaactgatttctttcacttggtatagtgttttcaaggttcacacatgtagcatgtatcactacttcattgtttttattgccaaataatattccattgtatggatataccgcattttatgtatctattcatcagttgatggccaactgagtttttcccactttttggttatttttaattatactatcatgaacatttgtgtgcaagtctttgtgtggatgtatattttcatttctcttgggtatgtacccaggagtggaattgctgggttgtatggtttaaccatttgaggaactgccaaacttttctaatgcaggtgcactattttacattcccatgagaatgcattggagttctgatttctccacatcctcaccagcactttttattattatctgactttttgattatagccatcctagtgggcatgccatctgttcttgagataagtttagaatcatttttatcccattgatatttttaatgagattgctttgaatttatggatcatttggacatgttttcagtggttaaggcttactatttaagaagagcatgctttttcaattaataaagtattctttaatgttccttagctttagctttatttagcagtccacatttaaagggtattaactatggaaatttttttttttttgatacagggtctcactctgttgcccaggctggagtgcagtggtatgatctcagctcactgcaacctctgcctctcaggctcaagctatcctcccacctcagcctccttggtaactggggctacaggcatgtgccaccacacctggttaatttttgtattttttgtagagatggagttttgccatgttgcccaggctggtctggaactcctgggctcaagcaatccacctgcctcagcctcctaaagagcttggattacaggtatgagccatcagccagtttttttgtttttttaaatcattgatttcaactatgctctgttgaatcccttttccatcccctcatgtctcacatgcctcacataacttcccaggcattgtgttttagaaagtctggtattgtttaaattctaacctcattttgctcttctccagagcatgtccagctagtcactaaagggacttggaatggggaggagataggtgcacccttcctttcctttgactccagctgttggagctggagggagggcgtgaactggcaccgaggtgaattctccccattccttcccagcttcctgaggcctagctcctccatgagctggggagggagaaaagaaggaaaggggacagtggtacttaccaggcagctaccactgtggtcctctcctttgatggactccgcttttctagccagtacttaactgctgatgccttctgtgcagcaggcgttgagtactcctctttctggggtccatgtgagagttctttcagagctcactcttctatgtactctatgtactcactctatcttatgtacacagttgttttcatgggagatgcagctctgtctggtctttcctgccccctccactctctccaactgtacctcctttctccatcttgcaatctctctctgattcacttcactcgtgctcagacaggcatggagagcaggtcagcaaattcttcacactatcagactttagacaagctaaggaatttccttctctgcatactgtatatagcacagtttgatttatgtaacatcctaatcatactgtctggaagaatcttaccaaaatgatattattcccctacatggggaattagggcttgattttaccttctttattataattatttttacttgatcaaattactaggaaatattcctccacttctaaagaatacaatttccctgtgttagaaagatcagttctggtgtggtggctcactcccgtaatccctgtaccttgggagcctgagatgggaggattgcttgaggccaggaattggagaccagcctggacaacatagcaagatcttgtctctataaaacactaaaaaaaaaaaaaaaaaaaaaattagccaggcatggtgacacactactcaggaggctgaggcaggaagatcacttgagcccgggagtttgaggctgcagtgagctatgatctgccactacactccagcctggatgacaaagcgagaccctgtctctaaaaaaataaaaccaacaacaaacatacataaataaaaagatcacatccaaataatagaaaaagatgatatggttttggtccccaaaactgacatcatgtaggagatattggaactttgtgggtgggagccaagcccattctggtgccccttctctaggtcacgtctatactgcttgtttggattccttggcaaaaactgattatgcaaggcagtaggatgcctggctcaaattgggtcaatcagatcctttttcttggaatttaaaaaaaaattgcatgaaaacgtatagttaaatgcacaggtcttaagtgtacaatttagagttttgacaaatatatacattcatgtaactgaaccccaaacaagatatggagcatttccatcaccctagaattttcattcatccccacttccagtcagtctcctccatccatgatggccaaccactattctgatttctatcactatacactagtttgatctttgtttggacttcatgtaaatgaaatcatacagtatatattcctttgtaactggctttttttaacctaagaatgtttttcaggcttatccatatttttatgtgaatcagcagtttattcttttttattgttcagtaatatatcaatgtgtgaatatattatccattcgcctgttgaaggtcatttgagttctttccagtttcgaactattatgaataaagctgctaaaaacatttttaaaacaagtcttgttgtggacataagtttttgttggggcagggatttaaatagctaggactgagattgtcagtttattggataggtatatatttaacttgagaagaatctgccaaacagtgctccaaagttgtgcaattttacactctccgcagccaaaatggaggcttccagttgttgtacatccttgtcaacatttgagatgtcagtcattttcactgtagccattctagaggctgtaaagtggaacctcctggttttggtttctctttcactgatgactaatgatgcacaacttttcatgtgctcattggccatttgtataccttcatttgtgaagtgtctctcaagtcatctgcacatttatcttattgggttgtttgtctttttactgatcagacatatgtattctagataaaagtcagatatatgtattattgatatttcaaagcattttgttcagcagtagaaatgctggctatatgatttgagaataaaaatacgtatgtaatcgtaacaagaagtcttaaataaattaaaatgtcactattttgaataactagaatatatattaagaaaaataatcccaggaaataaaaaatatgctagtaatatattaattacacataacaaatttacaaaattatattaccatataacagtaatacataattctaaataaaaataatcatgctcacagataaaaccaaaaactttaagagcttaatttattgaaaggaaatgatttaaatatcatgagggaaataaaaggagacaagaagtagtggaacactctactgtgctcctgctgtttgggaagatgtactatacagagttaattcaacaataaacaaagtccctgagggatggcctatacaagttgacaagttgatgtaaaaattaattgagggaattaaacagaaatgtaaatattccaataaccatcgaattatacattttaaatggatgaatcgtatatgtgaattatatctcaataaaacgattataaaaaaagaataaacagggattttttttttttttgagacagagttttgctcttgttgcccaggctggagtgcaatggcacgatcttggctcaccgcaacctccacctctcaggttcaagcaattcttctgcctcagcctcccgagtagctgggattacaggcatgcacctccatgcctggctaattttgtatttttaatagagatggggtttttccatgttggccagactggtctcagactcccaggcttaggtgagcctctcgcctcgctctcccaaagtgctgggattacaggcgtgagccactgcgcctggcctaacagggaaatatttttcaagttaaagcaaaaaaacaaggtaagccaagtaaaactatataaaaatatatgattttggtgtttacagcgcattgggtaaaaaatcttactcagaaacagtatgtaaaatatttcatttttagaaaactatacattaaatcaatggagagtggccaaaaaattttaacactgtttatctcaaggagctacaactatggtaaatattttccttaataatgaaatgtggaaacatttctgagaacagaaataagacgaagatgtccattatcatcacttgtattcaatactttcctggtattcctaacaagagtaataaggcaaaaaagttgaaataaaaatactaagattggacctaagatacaaaactatgtatgtatattaacaactcaaaagaatccagagacaagttattagaattagtgagtttagcatgactgaataaatggtcaaaataggaaaaccaattttatttctgtataccagcaagagttagaaaataaaacattttaaaacaataccatttatggtagcataaaaattcaaatgtctggggaaaaatttaatgaaagatgtccatgacactttaaatattatttagagaaatgagagaagaggtaaataaacagaagtacataccatgtgaactgattagatgacccagtattttaaagatgtcaattctcccctgaattgacttataaactcaatgcaaccccgggcgcagtggctcacgcctgtaatcccagcactttgggaggctgaggcgggcagatcacgaggtcaggagatcgagaccatcctggttaacacggtgaaaccctgtctctactaaaaaaaaaaaaaaaaaaaaaaatacaaaaaattagccgggcgtggtggcgggcgcctgtagtcccagctactcgggaggctgaggcaggagaatggcatgaacccgggaggcggagcttgcagtgagccaagatcaggccactgcactccagcctgggcgacagagcaagactctgtctcaaaaaaaaaaaaaaaagaaatggaaaaagaaaaaaatctcaatgcaatcccaatcaaaatcacaacaggcttcatatatatatatatatatatatatatgtgtgtgtgtgtgtgtgtgtgtgtgtgtgtgtgtgtgtgtgtgtgagagagagagagagagagagagaagttgcatggttaggtggtaaaagcagtgtttgccataaaaatcaggtcgttggttattttggtggggagggagaggtagtgtttggaaggggacacaagggaaggttttgggacgcatggtataccggttgtcaatgtatggcctcgcacctccaaatccatcctttaatacctgctctgtgggcacagccagaatccccttccgcggctcccctcgcggcagggaggatgctgaacagtagagggcgctggagacacgctgcgggaggctgtcgctcgggtccggctgcgggccacaggccgcggatcgcgctctgccagcgccccacgcccgcaagcgcggcccctccgccacctcgcggcccggcctgacctgttaatcacgtccccacggctctcctagcggggacaccgccgtctgcaggctccgtccccacagtgcccagaccccgggaagtttgtcagtcagcaccctgatgccagccgattctcaaaaagccaggaggatccaagcagatgatttgccagacggtactgcagcaatggagatgaacagataattcacacagaaagaaggacggtagggagagacgtgcggggggtagggagggcggaaggaaggtctaggggaaggagcggagggggaagggaggaaggaaggcagcaatggaatgaaaggagaagggaggaaggactcgttgaatgcacagcctccccggtgctgcaccgacaggagcggctctcacaggcatggggcccccaacagaccctaccaggctgcgggaatgttgcggccctgcagggcgtctctgtcttttttgaggtgtctctggtaatatgtgataatgacagtatttttagacatttggaatctgatttaaattttagctccatcaccttctagctgtgggaccctgagaaacagcacatcctcccggatcctcccatctctcttgtccacacgtggggaaggctcctggtgggggggggttgggggggaggggggaagggggggttggggggagggggaaggggggggccttgcagatttaccaagctgatgtacaaagacctactacagcggtaagggctagctcctttctcccactctggcagtcactccactttgagaaacatacatcttgaaataaagctacaagtggagaggggcaggtgatttgggcaaatgattccatactaaatgttaggacaaaacatcctaggcaaatatcacaatccggcgtcatagtggcatactaaattcaaccaagaaatatacccatgatgttgaaagagccaggcttatggaatgtaaacagcaaactattttattcttgttttctatttaccaattcaaacttactctgcaggtcactcctccctgcccctgggataaaatctagggcatgttctgtgactttctggatcacaaaattcacatgatttttggatcattctcagttaaccaaaaatgtgtcctgtaacttctagctataaaaataggctctgttcagcatttaaaatgtccaatcccatgtaggagtctaaactttcgatttcattttaagtttaagcttcctcttgattcctcccccaagtctggcccaggcttgcatttggctccaggcattgggcgggtagcagtgtttcctctccatttttcactttcactcttccctccccaactagcttgcagggatttctgatcacctagtagagtctagaggcgtaagggaaggaggtcaccaaggggcaggccaggctttatgtgaatagtgctgttgtgagccaagtacttgagtacttcgaggtccccttctactgcagacatcttccctatggttcctgtgacccaggtttgtctcagagtggggttagcacacggtaccatctccatcccctttaaaagtatttattacatttttctggaaatggaagtctgggaattatatttccctgatagtcttatgagcaggattccaggttgattctgccaaatgtgaggcactcaggtgagactagaaagcagaaagatggtttaaaaaatcatcgttttcttcctttgactctgcacttatgacagcaggatgctcgagactcttgcagtaatttgggcaaagatttccacagtgcaaaatagaaaaaacgtaactggcaaatagctgtacaaattacagtccattttcatcatggaatgtcagtttggcaacaatggcatcgaggcccaaaagcagctctgcagtaggggggttcctccttggtgactggatgggcacagcgaagcacaaattcctgaagatcccagctccaggaaacatcagcatggttcattgcgttgtccacctgaattcttcacccctccctgtggctgtgtccattgccctgtagtgttgcagttcccctcaggaaaaagatatcatttacttctctgacccttgatttggagcttggctatgtgacgtgctttggccaatgggatattggatgacataacataaggagagacacagatatgcatctgcacaatgcagcttgcctttttatgcttctgccttcaccatgaaaagagctttccctgggggtagcagctgtccctgcagcctgtgttcagaatgcacaaatgtgaggagccaagcccagccagcttgaaagtgagttgccaggcccagcgcagtggctcacacctgtaatcccagcactttgggaggccgagacaggcagatcacctgaggtccggagttcgagacgagcctgaccaacatggagaaacccccgtttctactaaaaaatacaaaattaggcctggcgcagtggctcacgcctgtaatctcagcactttgggaggccgaggcaggcggattacctgaggtcgggagttcgagatcagcctggccaacatggagaaaccccgtttctactaaaaatacaaaagtagccgggcgtggtggcacatgcctgtaatcccagctacttgggaggctgaggcaggagaatcgcttgaacctgggaggcagaggttgcggtgagccgagatcacgccattgcactccagcctgggcaacaagagcaaaactccgttgaaagaaagaaaggaaagaaaggaaggaaggcagacaaaattagccgggcgtggtagcgcatgcctgtaatcccagctactcaggagactgaggcaggagaatcacttgaacctgggaggcggaggttgcagtgagctgagatggcgccactgcactccagcctgggcaacaagagtgaaaccctaaaaaaaaaaaaaaaagtgagttgcctaccctagctcagaccacctccagccaacccacagatgtgttagaaatgagtgcttatttaagtatggcattgacatgttgtgattagttgttatgcaccattatagcaaaaaaattgcacactgataaaagtaactgttccctcgttggcttcaccagctttcccaagaattgtttaatcccattccctgtataaaatcactctctgctgagaatcctttttctgagaaaagaattctgagaattttttttctgcttgaggcagaccaacactcattccaagaacaactggaaaggctgaataaaacacagaaaacttttttaaaaagtttttggaaagcttcccagttaacaaacatttgaagggtcataatctcaaaagaagaaaaacacaaggaggcaagctggccctctgtgaactacttttcccttcaggaaacgtgctgattttagctaagaggccgagcatttgggcagacggccatagctaagaggcagcaaaggcagcagagtcgtcttcagctggagagacaagaaatggagactgaggttgtcaaggcagctggaactgaaggggccgagatatcatgtagaagggagacacagaaaaggaacactttccccttgaggcatctgctgagttaagctatgcagaaaggctatgaaaagcagcaggttttggcagtgtcatattaatgagataaaagttggagttcaggacccaccaaggaaaagaagcctaataatcacatcagacactcagttggaatccttggaggaccacactctagatagacgggcaaaccagagatggagatgaagccttccaaaaactgcaacatagactctagtcagttcggtaccattggattaaggtaaaatcttcccactctgtctatcagatgacatggtaaaccctcccttgagacagacattgttttcagatcatgtttcctggagccactaaaatttattataatggttagcattcaacaataagtgatcaaacacaccacaaaacaggaaggaggggaaaacagacacaacaaaacggagccactaatgacccagatattggtgttatcagacacagacttgatgggtggaatagagactttcatcaaagaactggaatctataagaaagaatgaaatggaaatttaaaacttaaaaatacaataattgaaattaactacttagcatatgggttaactacaattagatttagcagaaggaacattctttgaactgtaatataggacagaataaaaactctaagctgaagaacagagacaaagagtatggaaaatacagcaaagaacataagatacttgtgggaggtggtgaacaggcctaacacatatgtaactggagtcttagaagggaggaagatggggcagaaggaacagttaaataaatatagcctgagaactttccaaaactgataaagctttatgatccccaagcaggataaataaaaacaaaactgcatccaggcacactatactttttttttattattattttttgagacggagtttttctttgtcacccaggctggagtacggtggcgcgcgatctcagctcactgcaacctccgcctccccaaggtcaagcgattctcctgcctcagtctcccgaatagctgggattacaggcacgcgccaccatgcctggctaatttttggattttttagtggagacggggtttcaccatgttggccaggttggtctcaaacttctgacctcaggtgatccactggccttggcctcccaaactgctgggattataggcgtgagccaccgcacccaacccaggcacactatacttaaactgctgcaaatgaaagacaaggaaaaaacagtaaaagcagctagaggcaggtaggagggacacatttcttcttttcttttttcttttcccctccctccctctctcctccttcctgcctccctcctgtcattttcttttgtagaggggggggatcttgctctgttgcctgggctggttttgaactcctgggctcaagggtgctgggatgacgggcgtgagccagtgcatgttactgacacattactctcaaaggagaaacaatagcactgaaaatcacttgtcaacagaaatgatggaagtgagaagataatggagtgccattctgaagttcctcaaagaaaaaagtgtcaacctgtaatcctatattcacaaaatatacttaaaaatgaatttgaaatagatgtttctattcaaaaactgagaaaggctgggtgaggtggcctgtaatcccagtcctttgggaggtcaaagcaggcagactgtttgagctctggagtttgagaccagcctgagcaacatggtgaaatcccttctctacaaaaaatacaaaagaattagccaggtatggtggtgcctgcctgtagtcccgctactcgggaggctgaggtgggaggactgcttgaacctaggaggttgaggctacagtgaaccatgatcatgccactgcactccagcctgggcgacagagtgagaccctgtctcaaaaacaagcaaacaaaaaaacacaaaaaaacctgagaaaatttgctgccagcagatgtgcatacacaaaaaatactaaagggaattcttcaggtagaagaaaactgatctatgatagaatcacagaaatgcaggaaataataaaaaaaaacagagtgaatatgtgggtgaatacaaatgaatattgactgcacatagcaataataataatgtctcgttaggtgtaaaatatatgtgaaattaaaatgagtaataataatatacatgcaagagtagaatggaggtaaatagagattgagtattgtgagatcatagcattgtctgggaaacaataaaaagtaaaatttgtattagattataataatgtacagaagttgtaatctgtggaggaaaccactaaagaaattataaaagaatgtgtaagtagaaccaatggtagggggggaaacggaattaaaaaaataatcagaaagaaagcaacagaaaagaaaaaataaaaacaaaaatgggtaagacaaatggaaacaagtagtaagatggtatttatgaacacaactatatcagtaattacaataaatgtaaattcacgaaatacacaaaagacaaaatttgacagacttgattaaaacaactctattcaagagacatgacatcattataagaacattgaaaattcaaaaataagggggaaagtgaaaaaaataccattgtgagtggtagagaaagccatttcacataataaaggttcactctaccagaaaacgtcaattttaaatgggtatgagcctaataacacaacctctaaatgcataaaacaaaaactaacaaaactcaaaggagaaataaacaaattcataataacagtggcaggctttatcctctctcagtaatttatagaaaaacagacaaaaatatcagtaaagatgtagataatttgaccaacctgattaacaaacttgacccagttgaaatacacataacacctgcacacaactgcagaatgcacattctttcaagtgcaagaacattatgataagaatattataggaaagtctgtcataaacatagcttatataaaaatataacagcaaattaatctaaattttatttatttatttacttattttatttttttgtttatacttatgtcataaacatagtttatataaaaatataacagcaaattgatctaaattttatttatttatttatttacttattttatttttggagacagagtctcgctttgttatccaagctgtagtgcagtggcgtgaacatgactcacttcagccttaacctcccgggctcacgcaatactcctgccccagccctccaagtagctgggacaacaggcatgtgacaccatacctggctaatttttgtggtttttgtagagaccgagtttcaccacgttggtctcaaattcctgagcttagacaatctacctgccttggccttccaaagtgcggggataatagatgtgagccactgagctcgacttaaatctaaattttattttattttattttatggccatgctccctctaataaatctaaattttaaataaataagtccaagtattgttgtgtttatgtgtataaacctgcgcacacacacaaaagtgtacacaccctgctggtttctattacaagaatgttaagtttggtttgacattcaacagtcaattagtataagtcatcacatccaaagaataaaggagaaaaataaaattatttcaaaaggtgcagagtaagtatttgagagaaatttaaccttatttgtaattaaaaaaatctttttaacagcttgagaatatatgttaatgagtacattaaaaatcctataacaaccatcaaacttcatggtgaatattgacaactctccacatgccacacccaccacccctgagattgaggatgagacaagaatacccactatcactacttatagtcagcattctgctggaggtcctagccactgcaatttgtataccaattttatatcttgcaaccttgccaaacttattagctctagtagtttttttgtgtgtggattccttaggattttccatagacaagattatgtcatgtgcagatatagttttacttctttctttatgatctggatcacttttatttctttatcttgtccaattgctcagccactgcagtttggcaagagctaaataaggcataaagattaagaaaggaagaaataaaactgtcattcacagaggacatgattatacaaaaataatctgcaaattattacaatttaaatgaatgtcacaaagcctctcactggataacaaggtcaacatagttttgtagcaacagaatctgtatatactagccataaacaaatataaaacgtctaagaataaatctattgaaggatgtgcaagaacactttactgaaaaccacaaaaatagttctgagaaacatacaaaagacttaaagtgaagagatataccatgttaatgaataggaagattgaatattttaatgatgtcaaatggcccccaaattgttctacataatcaattaaatccaatcaaattctagcactttattttgtggaaattgactagctgattctaaagtgttttatggaaatgtaaagggcttctttcttctggagttgccttgtggacaggatttgagacaacccaggccaggtttctctggtccatgggaagcatgcgtatgctttttgccctgactatgtctgtagagaacagcccaaacaacaacctcctccccatcagagcagagagccagctagtctcttgccatttagatttttcagggatgagtcagagataccagtctactctgtcctgcagaaaaggatacttatcaacttttccaagcggccctagaaaagtcactgctagtcagaaatctcaccttggaatgtgggggtggctggcatctatccggatgtcagatgaaacagaaacagttccactgtagtagcctgctctataaacacacagagaacccctattacatgtgagctatgaagctattagaaactacagctttgcggactactttgaaaatgtgcaagtgggccgggcgtggtggctcacgcctgtaatcccagcactttgggaggccgaggcgggtagatcatgaggtcaggagatcgagaccatcctggctaacacagtgaaaccccgtctctacttgaaaatacaaaaaattagcagggcgtggtggcaggtgtctgtagtcccagctactccggaggctgaggcaggacagtggtgtaagtaaacccgggaggcggagcttgcagtaagcctagatcgcgccaccgcactccagcctgggcgacagagcaagactccatctcaaaaaacaaacaaacaaacaaacaaacaaacaaaaaatgtgcaagtgaaataagtgacaaaaagcaaacacaagatattctgttcatacgaaacactgcgaggcgacacttgtgtttgtagattgacagaaattggaggtggagttaaagaggtagaaactcagtataacattcattgcctcttttgctaaagttgtttcactgcataagaaaaagatactggtcgggctgggtgcggtgactcatgcctgtaatcccagcactttgggaggctgaggcaggtggatcacctgaggccaggaatttgagaccagcctagccaacatggtaaaattccgtctctactaaaaataaaaaaaattagccaggcatggtggcgggcgccagtaatcccagctacttgggaggctgaggcaggagaatcgcttgaacctgggaggtggagggtgcagtgagccgagatcacgccattgcactccagcctgggtgacaagagggaaactccgtctcaaaaaattaaaataaaaaaaaaaaaaagaaaaagaaggaaaaaagagaaagagatagtggttccatgtgctgttctagttacacaaaacaacgtgttgacgtgcaggctgcacgatgccaggtgcaaatacacactacctgttacagtaactgtgacaagcacaagggctgctcactagcttgagtgcaacttctggggagttgatggcagtgatctgtgggtacttccttcttaacaaattttacatcaatactgcaacacagcaatctcagccctgtgggctataccatagccacatgctttcaccatttcctgctcaaagggagagcccaggaactgaatgctcttaatcagggagagcacagaaacagcagcagaacagctggagaaccagggctgtgtggttttggactgtggggagggtgggccatgggcagacttgacacaatgtgggagggcatttgacacagccccgtggaggacctaatgctcggggaggccttcacccagcacagtgagccatgccgacacttggtgcctgagtgcgctggtcacagcgccctccctgtgattttccccatagcagtgtgttttctctgccaggcagaaggcagagaaaccctggctgaaaaagcagtgagggtcatcgactgcatgaacacatcatcagctttcccagatggaggcacccaagtttaccctgcaggtccattcagcaggtagagctgggtcatcactaaacaggatctttcttctgagcatctgagattctggtccaaatcagggctgtgaggaccaggagccgggattccgagcccaggcagccccgcagataaggaggagggagtgtgtcggaaggctgtatggccagagccgctgaccgggccagggcttctttgtcccctcttctctcctgcatatcagcactcacgtcctcctggctcgggctggctggcagctcggggagctgttggatgaaacgtccatgcgtgtggctgtggctgtcacatgcaactgcgaggatggtcggctcccaaagcggaaccgcggtgctgggcgaagggtcagggctccgtggtgcggcagagcgcatgccagcgcttcaccagctccttgggcttgctgagcatctcgtcccagtgctccagctctctgccgcgggtgtacatgtaggggcccaccaccactcggcccagctgctggctctctgcaggggagggagagcaccggtgtgctcctgagcacagaagccccgtccccagtgacctcctttcctccctcctcctccccaggaggaagtagcaactcccctcctctctgagtgggagctgacaggccccaaaggggccctgcctttgctctgcagctggaagggctgcttctccccctgggagattgggaggaaggagagccctgaaagactctctccttgagggccaccagctctgccccacacccttctgtggggccgtattaagtctaccttatgccaaagagctgagggaggaaagggcccctctagaaagaaggcctcggccatccgagagtacattcagcagtaacattcactggccaccgtggagaagggtcttaagtccaggccatgtggccagccacggcctgatggctctgtttccccagagtggcagtgggtgctggggtgtggggcagtgtgggagctggctgacagaactcgcccagaaccccaaagtctcatctggagggcacgaggaaggtcagagcaccaggtccctgggctggtggcaggcctggcccctcccactctctcgggtgatttgctccaggagagggcagcagaggccattgcttaacctctttctttttcttttcttttcttttttttttttttgacagagtctcgctctgtggacaggctggagtgcagttgcaagatcttggctcactgcaacctctgcctcccgggttcaagtgattcttctgcttcagcctcccgagtagttgggcctacaggcgtgcaccaccacgcctagctaacttttgtatttttagtacagacggaattttactatgttggccaggatggtcttgatctcttgacgtcgtgatccacccctctcggtctcccaaagtgctaggattataggcgtgagccaccgcacccagccaacctctttttttttttttgagacgaagtctcgctctgttgcccaggctggaatgcagtggtgcgatctcggctcactgcaagctccgcctcccaggctcatgccattctcctgcctcagcctcccaagtagctgggactacaggcaccagccaccacacccagctaattttttgtatttttagtagagacgtggtttcactgtgttagccaggacggtctcgatctcctgacctcgtgatctgcctacctcggccttccaaagtgctgggattacaggtgtgagccaccgtgcccggcccttttttttttttttttttttttgacagattcagcagcctcgcctcctgggttcaagagatcctcccacctcaacctcccaagtagctgggattacaggggtgtgccaccacgcccagctaattattgtatttttagtagagatgagcgtttcaccatgttggccaggctggtcttgaactcctgagctcaagtgatccacccaccttggcctcccaaggtgctgggattacagatgtgagccagcatgcccggctgcttaacctgtttctagggtgccacagacagagctcaactggactaaagctgggcctgaaacccaggccttgggcaatatttcagcctttctgagcactagtttccttaaccagggagggagctcgtacagctccttctgaggtcaggacaggaggcactcactctgcctgaacactcggcagcccctcgtggtccccatcccagcagcccagggtagggtgtggccttactgtccccttccatgttctgcaccacagtcaggctgaggctagcggtatccagctcggtggcatcggccttgaagctgaaggtctcattgtacacagggttgatggagcccagcacagctgaagtcttcttgcacttgacaaacttgttgtggttcatcagagacactttgacaaacacacctagggaacggtgagcactagtgggctggcagaggcaggtgggagcagagcccctgcctgtgggaggtccggctaggagggcacgtgcccaagctaggtgccagggccccacccctcacacagtgctgcggccccgccggcgtgaccagaggaagccggctgaggagtgcactgccctgcggcccaggcggggctccgctcccttccttttccttcctctttgcatcaggaaagtacccacggctcctgcaggccctggtttaccagagcctagcaccgcaagcctgtccctccctgttggggggctgctcactgggcccccaggccccctggggccccttaaacaccttgtacagagggctaagatttggtgggtgagggtcagagtcacagtggaaggtctggatcctgcctggcttacggtgaccccagatgtgaacacaaacaggtggctgaccaccacctcactgggatgggtgggatgtgtggggtgagcccaaatggggtgggacatgtggggtgaaccaaggcctccccttctgcagctcctgtattctgggaggccaagcatcagtgcccattgagtcgggggctcttcccctgtggggagggaggtgcgggcctcaccctggaggaactggacccatgccgctgatggaaaggtggaggtggaggcaggcaggacagttcaaagagccaagacgctgcctcgggaaacaggaggggcagggcctggtattgcggctgggttagaaccctccgtaggggaggccaaggagatgcagctttgggttcaacacaggaagaggcttcctgcaccagaactgtcgaccgagggacagcacgtcttgtgaggtagtgagcgctccatgataggtgtatgcaagcagaaactggatggtcagggatgaggttggactgtagccccaggctgtaagctcggtgggtgggaccttccccaggaggaaagggaggaactcactgacaatgcctctgtcctcctggagccggaggcccttggcacgcagcacaaccaccgtcaggcggctcaggtagtcgttgtagctgaggcagaactggaggtcgccaaactccgaggggggctggggaggccaagatggaagcaccccaccctgttactctggcaagtgctgaaggggtcacagaacccccagagagcctcccgcttcctcctagcggtccatgcgacacacccgcatggtcccctttgagttccactgccattttaaggatggggcaactgtggtctggagagtttaaggggcttgtgcagtcctgtggaccagagctaaggagtcacacccaggtctgagccagctggggccttcctgggggtggtgggctggaggaaacatttccctgggctggaccatttgtggtgtcatctctcacagctgtctaacctagataagaatccaaatgtggatatttcaggttgctccagggggtctgatggccagtgtgacaacaggacctcaagcaggccctccctgcccaggggcaggtccgttcccacctgtcccatgctgcttggggcctgggccctcctccctgagtcactgttgtagggtggtgtgcaggatgctgagggctgatgccgccagcaggtgctgggccctgtgcacacctgccagctgatgctcagtggcataggcatggtgaccttgaccatacctccaggctctcggcctccaggtctctccagatgacacgccggcagtcccccactagggtctcattcttcaaggggaagagcacctggcccaggagctggtgcttcctctgcctgtccacgtggtagacggagaacttcagcaccctctgggtgatggtcttgctggacacctgggggggacaaggacaccagccagagtcaggcgtgggggtaggggatgggatggtgtgacttgttattctggacatgggtgcttttgggaacgggtgtctcaaccagggacccacatcccccaaacctaggcattttcaggggacccttctcagcagcagagccgtgtacccctggaaagtgggggtaggtgccaggaccttggtacacagagtgtggtccgaggacctgtagcgtctaccaccacttggagccctgttagaaatgcaggatcttgggccccagcccagattcatgaattggaatctgccgtttaaccggagcaccaagtgacatggctgcacggtgagtgtggctccgccaccaccctgcactgtagcaaaggcccaggagcccagggcaccggcctgtctctgctgtcagagctgggcatgccagctctctcctccctgagatttggcctcctcgcctgtgaaatggggattatgggtcttcctctctggttgtaaaaccccaatcacagtgtctgacctccagcagatggcccattaatattgattttcttttctttccccttctcccttttccacagagggattggatcaagctggggcgagatagagtggggaagtgatgagctaagaaaaattagcctgcaagcatgacgtgtcgcacgtcagcaaggctgcagccttggattctgatgtcttgagaagagcgattcacctgtgaattctcacagccctggcctcagaaagacggcccgggaccaggcccgatggcacccctcttcccagctctcagccagggcggaaggcacaagtgatggccctggcctccgcagtcacactcctcctgaaagctgactggctgaacctcacctcttggctagcttgccacccagctcttgagaacatgtttgtccaaggcctcttggcaggtctcgatgactccttcccctaagggcccccagtcacctgctaaggctcccaggcccctgtgaaactggctcggtgccccaatagactctccacctccagaccctaagccggccagcccagagtgcagcaaggcaccacacctaccctgtgagggcactcgggccccgcgctggcctctgacagcacaggaagcttctgcattcacgctgaggcctgtcttttgccttccttagataaacttgccagaaaccccatagtgcttcaggcctttgggataattcccctgagccccataggccagggcctggcattcagtagttgctctaaaattgtgttttcacccactctcttccaggtagtcaggacagggaagcccaggcttctggtcaccactcaccaaatctctcccctgcccctctatcagggatcagctcctataggccttaacctagcagactaggtaaagcagagctggtggcatcaagggtcccgggggctgcagagccctggctggtacaggaggctgggctctcctgtaggtctgcaccttcccagcaacgcggagggcaccagaccctgcctgctccagaggctgtacctgaaagatgaagtgctcgtcaaactgcgggttggaggttttgcgtttggtcttggattggaggaagcgccgctcatcgggcagcaggtagagcttcaccagggggctgcaggtctccgagggggcttgcaggtgctgtgccttgatcaagcccaccagcagccgctcagcctcctgctcatattccaccgagaaccacagccgccccaggcagccgtcggggaagtcggtctcacttttgtcctccgggaacttgtacagctctgggttgatggcccccaccatacatgcatctcctatgacagagggtgggagggctggcaggccagaggaaggcaggggcatgggagacagtggcaagctctgggcacccatccccatcctggcccatccgtctctgctgagcctcagctagcctgaccacatctgccccactctcctcaccaggctaaacacatcccctctctctggtgcagctcctccaagaagccttctcaccatgaaggcattgcatggccaggctggggatccagcagagtcctgccccctgggattggcccccatccttggaggtcaggacctgtttcaaggacacagtgcccatcacctggcctagcccccttccatggcgtctagggaatgactcagcgataaaacattgcctttcttcttcctcttcaaattagaagggccaaggtgattattgggtggttcctgtgatggtctcttggtagatcttcagggcaaagaggtggcagaaagctgtgtttgcagcccctaccattctgtcctcttggtcaaccaacccatcatcctagagtgggacccagcacaagttctgtacatggcgtgcctgggttccaattccaatctgttgcttacagcctcagttaagactatgtaaaatggggtgataattcctccccctcagagtcatggtgaggtctcactccaaatcagcacccaaggccatatcttaccctcatggggtgcagcaagcacttcataaatgaaagcacccagaaagagtggtccctgggtggtccctggcatccctggctggttcaggttgtgttccggagccaagctggtgaaagcagatggggccacccgagcagaccctgacctctgggcagccctggcaaggacactcaccaaggccgccgctggaggtgtgaggcagcagctctgatgccgggcaggggtcccatggggcatcggcccactctccactgtgcaggggcacccaatctcggccttgaagggttgggggcaccacgaatggcacagctggtggcctgtccagagtcagggagacaacatgtaggtggcaagtcaatggtgtggtctcagagcgctcagccaggacggttgagcaccaggggctggaggaagaaaagccatcgggagccaggaggaggccagggcaccattttctgggcccataccaggcaacacacacacacacacacgcacacacacacacacacacacacacacacacacacacagcagtgggatttgaagaaggaacacagcacctgacagtgtcagccagtctgggtttggattcctgttctgccacttactaattgtgttctctggacctgttgcttatgtgcactgagcctcagattcctcacctggaacatgggtttcataacacctgcctaatagctgatgtgaggtttctggggtttctttgtgatagctcccagcaccgaagcagcatagaagaggcacccccataaacagaactttccttttcgaccccaccctgagggaaattccaggggcgcacttggccccacatcctgcctcacctgctcagttgggtcctagcatgcggctggcagggcctgtcccgctgcccactggaggcagctgtggtggccatggctggtgtcccaggcagctcctcataggtgagggtggcacagaaccttctccacagacagcagcttgccccgatcaacagcagcagcagcagccccccgatggtgcccccaatcaccagggccagctgctctgggggcagagaccaccagtactatgatgcctgcctgggaaagccactctccctcacagccctggcctgctggggcagaactagggcagcaaccctgcctctgggtttgatctcaggagtgataggagcaggcctgctggggatgggttccgggagggatgctgctggctaggttccgccagctctcagaggagaagccgtttaccccagggtctgagagccctgggcagaaccttctagttttccttggaaaacagctggccctgcccttgggattctggcttaaagaagccatttccttgcgcttctgagtagaaatcaaacctgccctcaccagaacctccatatcccctgggctcctgttgaggccaggaggggagctggggtgtggacgcagtcagttaaggaaagccctgaaaggtaccttccccctggtctgcaatcaaacctctaccctctggggccctggaacctgctgcaaggctggactcttctctaacacccgctccctcccctagccctctatcaaggtgagcacgcgcttaggggagttggtgcgacgcggtggacgaggtggggaggaaaagggggcaagaccccgttgctgctggccctcacacgtccgcatttgcgggacctaggaggcttcgccccgggggtgctcagacgctgggttccaaccgctggccacctggggcgggccaaaaaggtgcctcccttagggtgacgtgcggccgcggggcattcaggtctcagggatctgcactgggtggggtggtgagaaggccggaccccccacacctcctaagccgcaactgaccgcgaagagcgggcctcagcgtctactccatcccagtgcccctccaagagcgcgccgaggccgggcagggcaggcgctgcaccccagcgggggcggcggggcggaggcaagtgctggaagggtcgcagaggggccggggctgggctggggaggcgaggctcgcttacccgccatggggctgctcccgcaggctggtctcgccggtctgggcggctggggctgggctgccaggccgtctcttaaagcgccgcggggcgccgtcgggcgagcacaggggcggtccgtggtgctgctggtgcccagctgcggcgcggggagccgcgcagtgcacggcaggggcagggacccagcgccccgaggccgcagtcccgccccagcccgtccctggcccaggcccaggcccggcggtggaggggcgcagagccgaccgtgagctcccggaaaccgcagggctccagccagggcgggtcccgggcgccaggggcgccaggggctccctgcggcttggggcagggtggggtgagagtaccacccccatcccggagagcagggctacagccttcaccgccgcgtctgacacagggctccgcacccgacccctcacacctggtggccaggactgagcccccgccctcccagatcctcctcaagccgaggcccctccagccgcagctccgaccccggctcgggggagccttcccggatcccggggtggagtctccgcgcgggtccccggccccagcgctgcctgcctgatggccttgggcagggatgcggcgctcgcgcacccgttcgctctcagcggacaaaccggtcgagagcgcaattctggagcgggttccagaagctcctgggttccaattcaggctcctcactcgccagccctgcgatttgggacaacttaacgttcgtaagctgggttcagtcttctcaattgggttaatgtccgtgaggggctctcgtaagggcggctggcctgccggtaacttaagaagcatgtaaagagcacttagagcggaggagcggcgcggcccagcccctgttacggtggttatcggatggaggccagcgtcgcctgggtcccctctgtacacccagcgcctattattatggtgattattagaacgcagggcccgtgcccactagtccaggctggcgaacgcgccttgcgggaaaggcgggagtaaggtcgctgcgtgtcctctctggtcacacctcggcgcgccctggtcgcgcccctatggttcccccgccgaggcctcgaggcgtctgagtggggagcgaaaggaatgtgtgtatctgtggtgcaggggagtgtgtgtgtgtggggggggggagggggtggttgtgggggagtgcgtgttttggggggatggaccttctcgttttacagccttgaaggttatgtccagagtcatagcctgggtcccacacccccgcgtcacctgtgcctgtcctagggggcagtcagtgtgcgtgaggctccaccctgcctgggctttggctcacctaaggcgaggagggtggtgaactggggtgccccactgggccgggtctgggagccctcagcgccagggtgcagaggccgcagccactccccttctagggtctgggcggtgggggcatgagaaggcggagacccaggccacttcacccagtaactgtcctcagctgtgcgcttaactggcgagatctccgctctacttggagacagtctggggtgtctggagaatcctcccccacttctgcttaccccaggtcgctgtgggagcaggtgtctcaggaaatggggcctgggtcccacccaaggcctcgggtctgagttagatgtctgtatgtttgttgttgcccctgcaacaaagtaccacagattgagtagtttaagccacatgcatgttatctcacagttcggggggtcgggaatctaaactgggttggcagggcctgtgccttctggaggcaagggagctgtttcccagcgtttccagctcctagaggctgctagctagtggccctttcctttgtcttcaaagccggcagcacagccttttctaacctctcccactccaggtcatttcacatcaactctttctgcctccctcttgtaagtgtgataccctaccttgttttaacctgaattgactgtcccttagctgagagagccagacacactccattttggctccttcacttgcagccccttacccaccccccttcctcaaggacttaacttgtgcaagctgactcccagcacatcaaagaatgcaattaatggataagatactgtggcaagctatatccgcagttcccaggaatttgcccagttgatagtaccctaagcccccacatttgtgtccggttgatggtacccaaagcccccgcatctatcgccttgtgatggatttaaaacccctgcacctggaactgtttgttttcctgtaaccatttgtcttttaactttttgcctgttttgcttctgtaagagtgcttcagctaggctcctcctcccctttctaaaccaaagtataaaagaaaatctagccctttcttcagggccgagagaattttgagcactagccgtctctcggttgccggctaataaaggacttctgaattcatctcagagtgtggcgtttctctataagaggctcatcagataatccaggataaccaccacccccatctcaagatcattaacttaatcacacctgcaaagccccttttgctatgtagtcacggggttggggatgaggacttgatatctctaggaccattgtgtggaccatgttgtccatgcagtaccctgggaggggtggcttacatttccccttcctctgtctagagttcagtgtgcctcaacactggactcaggcagctagcaaggctcaggggacccctacatggaacccgtcagctatcttgaccccttcccccagctgccatgcacccccacctgaccaccccaatggggcatggcatccacaccagctgcctccatgattgcgcccgagctgtactcaggctgttctgggggtggagttgggtagtgggatgttttttgaaaagggaatcccttctggcacttcctgagtgccaggcccagagctgccatctctcgacccccatgctgtgcttttccaaagtccccatctttctctgtgtcaccaagtcctgacagctgttcctcctctgtccatctctatcatggcaaaaaaccttgcccagccctccatcacctctcatctggagctctgcatgggcctcctctcagctcttcagattccatgctgcacccactccccttcccagctgttgtcttccaggctcccctcccattctcatcccccccaccacccatctctatgcagtgcttgtgcccagactgatgcagctacttccacggctctgcgtatgcactgggctctcccaccatgctgctctctccctgtctgaaatactcaatgcccctcccaccctccttctccactgctcatgtttcaagatgaacccccagcatcttgccttctgtgaaacccttcatcatcccctccttgtcctcatggtccttgcagctaccatgccgaatatgggactctgtgcctgagactgctgcctcactcttcctggcagccgagggcctccatgaaggcagggggccgtgtcttattcagcttggcatcgccactatccacctccagggctgaggctgtgctgaatggcagatgaagggctcttgccattgggatgagctgccccagcttctgcccacattgtccatgcatcatacacatcctgggctcacaatttagggcccaacaggagctccctgccctggtcctgcagaccagcttctggggtctgcaaaatcacgttgtcagctctatctgcaaaatccttacactgccagccagcccactgagttttgagtcaatcttcctccacgggaagataaaagcaggtggcaggagggagctcatccttcttgctgctcctgatgttctgagcattgagatgcaggcctgatgtacacgatcccatggagccctgcctcatgtctgccctgcagggtcatgacctcctcctcagatgaggaaactgaatcaaagaggtttcctggcccacccactaagtggtggatctaggcctggcacctggctccctcgttccttcttcaccagtgagcagctgtagggcaaggacccaggagaccctctcctgtggcgctgaccgtgaatcaggcaaagagccacaggcactttgggcagcctcccctccatccactgcccgggggctctgagacctggctggcctggagccagctccccagaacagaaaggcatccagggtctggcagcagctctggctctgcttcctgttttcagaccttgttcttccccgtgtctgtggagctgggaagcctggaaacagcagcagacatgggttctgtctttcatggccaagcggaagttttatttccatggcaaaagcacttccaaggagggctgcaggaagtccaagagtttaaagacctgcaaatgcctgcaggtgattaataattcattgcagcagatgattacgagaaaggccactttcaattaaccttaagaatcatccctgtctaaggaagtgtcatctctcatcactgaggaacacagaggccatagcaggataaaggccacgctgagaagcatgtggaagactgtgtttctcaattcatgcaaattgcaccaggtcagcccaggtccttctttgtgaggagggggagggttcccctgccagcatcctgtctgctctttggttctgctatggcggcctcagacttaatttcctccagccccttcttttgaggagcttggagggagtatctttccttgttggatcagaacttctcgtcccccactgaaacatgctggctccaaattgtgtctcctcctgcagacagtcactccgactggcagggtgggcttgggcctgtggctcgctcctgcccctgggcgtggtttctgcttcctgccctgctgctcccctgcctggcaggcctgctcccctgcctcctctcaaccagcaccagaactctgccttccctctggagggaacaacttccttccccttccctgtccacacagtacctggcactcccctactcacccctattctagcgctttgtccatgacccaggcctggctgctcagcctagttcatttctggctgcagtgataggttcagggatgtccctgtgaccccaccccctgcccccgcgagaggctaatcaggatcaacactggaattttgtgggatgtactggggaagagacacctcctttctggcaggagttgttgagcagaaggagctaagtctggggccatggaaagccccacgtggaggagccagagaggatggagccagcacaggtgctgaggtggggacctatgttgtcctggcagcccctgcatcctgctgcatgcagcccctgcccctggaggggtggagagagagggcggcagaggggagtgagcccgccaaggccactgtgttagcaaggagctgagccggcgttggcatcagctgttccagcttcagtctcttgaccaccaaggctgcccctcagcatggagcagaagtcaggaactgaggcaaggcttgtccttcctcaatcgtcacctctgggcactcagctgtcctaaagttttttgaccccccttagggatggggtcttttcagcaagggccatttgtggcaaacaacaattaatttactgctcagcctccatggctcactcctgcccctccgccagcttctgtgctaacaactgacccacatttttttttttcaggaacagcaatgtgctcagtcaccaggcatgcatccaatgagccataagagggcggaaagactttgttttttgatgtattaatatgctaaattgatgtgtcggttaagacatgaagaaattagctatcaaactccaaagagtggtgacagactaagacgcagatttccaaaggtggctgagaacctgctggacaactgtcccccagtgagaggaagggctgagagagtgagggagggaggggatttgccagattcctttcttgagggctggggctgtgatgtggactcccacctcctacggctggccagggctggggaggggggtgtgctcggggagggggctgtgctcaggtagagagggggcaggtggagcagaggacagcctcccctccagcccagagagttggggattcaactctgctctgagagcttgctttctgtcccctggagtttgggaggcagacggactgctggtggaggtgcacaggcaattgtggcttcttggttctgatgaagacagtaggcagctgctgtgttgggaagcagccaggctccctcagatgccagccaaaggtttgtggatcttgggcacatgacacgccactggtagtgcgagtgtggctcagagtgtgatggggaattgtcactgacatgtgcctggggacttgtcaggatgtggaatgtgtacatatttcccacaaccagacattggccatgtgaatgaaagagccggtgtgtgatcatctcagtcctgaccacaggccctacccagagggcatatgtagcacagtggaaggaagtaggaggtgaactttctaggggtagaggagggagcaagtggcttctgattcatttgctcaggtcaagggcactctggttctggagtgggtgtcaggggtgaaggatcgagggttcctttcaaagggcccatttgagcatgaaacctcttccagatctggagaggtaaggcatcttacgagaccgtcaagacagaactttccaaatccccttcccttcctctgctcatgctcttacctcagaagtctgctacgggcagtgagagaggagagaggaggctgaccatggcaccctctccaagggcagaggctgtctgtggctggccctcaccatgggagatggggagacttaactcaagtttgcagatttgattattacctaggtggcctttctgatgactgtcttgggactgcggggacagtggctagaagggaatgatctctgctgaatacctgctccttccaagtgtggcctccatagggagctcggggctctcacatgtcctcctttgttccctcaaatagatcccaagatcttgaacgagaccattttactgggctttagtgctcaaggctgaggtttcacttccataaaaaaatcagttaaaagtgctgagcctgtgggaaggctgttctttggttaccttctgtggtcaattaaacgattggtctcaagttctctcttccctgtactggtattgtactcccacagccttgcaacatggtgggtgcattagactgtttatattgcttataaaggaattcctgagactgggtaatttataaagaaaagaggtttaattggcttacagttctgcaggctgtaaaggaagcatggtgccagcatctgcttctggtgaggcctcaggaagcttctactcatggcagaaggtggaaggggagcaagtgtgtcaagtggcaagaaagggaacaagaaaagggatgcccacttttttaaactaccagatcttgcctgaactcagagcaataactcactcattactaaaaggaggcaccaagccattcatgagggatctgctcccatgatccaaatacctcccaccaggccccacctgcaacattggaagccacatttcaacatgagatttggaggggaaaaaacttccaaaccatatcagtgggacacatgcttccccatgatttgactttgagcatggccacatgacctgcttgggccactggaaagttggcagagatgatgcggcagaggctggaactgcaccgtgcggctggccttgctctcctgtgctttagccaaggcggtgagatgagcatggcccagggagagctggctccaggccaatgagtgctctgtggtgcaggtccaaaccccacctggagcctgagatcaaggagttcagcctgagccagcagaccccagccaacccacagacatggaagggaaaaataaatgcttctggatgatgccatagagactctgtaagcagcaaaagctgagcaaaacactgtcactctcttttgattcctttggtgagactagagctgtgagctggcagggccacaccccttgtcccctctccacatgcctcaaagttgtggctgaaggtggatgatcttgtcacttttccttactggctggccttggtcttctctggaccagcctctgctgctgtgggaggaataaagtgctaaggggtagtgggtttaggggaaagagagaaggcttgtgggggacatctgaggttttcacacagcatactttatccttcttttgttgcagtggtgccccagtcaaaagtgccctctgggaaagcccttccctcctcttgggtgtggttgactccaccctcttcttcttccagctgggcttgattcctccacaggtccctcctcctggctgcagagattggttcagggaaacacagagccaatgagctgcaaggctgatttttctgacaatgctggacagaggcaagggttcttcccgagggtcttgaatttaatgagagaatctcaaatgatgagaaaaaagctggtctgaggacagggtcagctgaataggtcgtacccagagaaagagagggagagagatactggatgctggtgatgggtgaatgagacaaggcatgaagctagaacaccacctggtttttcacttaggtgagcccacaaattccgatgtgtacttaatgccagcttgagtaggtatctgccatttgcaatcacaagtcttcaatgatacaagattgcccacctgctttgggccgtctgtggcccaaatttgtacctggccttattttagggacatacacctttcttgggtttgcacacacacatgtgtgtttacatttggacatagtagaacaaaataatttatataaggattttgaaatgctgaccaaataaataatctacaccaaatactttacttacgttgttttattcattcattctttttaaaaaattatttattctttacaaccaccatctatggcaggtttttttttttgttgttgttgttgttagatggagtttcgctcttgttgcccgggctggagtgcaatggcacgatctcagctcactgcaacctctgcctcccaggttcaagagattttcttgcctcagcctcctgagtagctgcgattacaggtgcccaccaccatgcctggctaatttttgtatttttagtagagatgtggttttaccatgttggccaggctgatcttgaactcctgacctcaggtgatctgcctgcctcggcctcccaagtgctgggattacaggcataagccaccatgcctggcctatggcaggtacttttatcacttaggaaatcttttggttacaatttacagtaaatctgactaaatctgactaaataagcctaaatagggcttacaccataagaagatttgctttcttatttcattagctctaagatgtcattgattgtgaaatgcaccactgttttgcaccactttctttgtataagcaaaacttgctgccaaaccatgaagccattctttactatcaaatcagatatgagaagtgacagtggtgtcagaatgtgaaaaaaaaaaggccttccttggaatggggagaaatggtgttacttagcaagacatttgtggttgggtagcctcagatttgacttggcagctcaacatcatcatctaagatccaggttccttggatgtgtcacctgctctgccaccttcaagtttcgagatggcttggtgtcttctaacaccaagttcaaaggcaggaaaagaaggaaaggaatctgatagggaaagtgtttatttcctcactcacatccctcatcttatcagaaagcctccggcacactgaccctccataccttgttgctcactggcgagacccacacacagccatgctggtttcaaggagaccaagaaagtgagtatctgaccttttcagtcctataatgggagactggttgaaggaagaggacataagaaatggctgtcaatgccacgggatttcaattccaattttacagatgagaaaactaaagctggaagaggttcggcaactcgcccaaggtcacacaactagaaatcggtcaaccccagatttgaatccagtgtcgaatgattcaaagttcttcccattgcaccataaatcatctgtacatgaaagaccgaagactgagaaacctcaaatacagagcaggtaaatagtaaggaacgtgtttggatgaaataccagaacacctgaccatcagtggatcagataggggtttattgttgttatgtagccagcaccccagagatcagcagcccagggtggcacagatgcttaagggtttcatcaagatcccaggctccctcatcatcctccttcaccttctggagtgtgtggtttctgtccttaagttcacagtatggctgctgcgtctcaaggcatcacatctagctttccaagaaacccctacctagtgattccctcttacatctcattggttagaacaaggtcacgtgtaactaaccccagatacaaggaagttacaaggaaaagtaaatatatttagctagacaattgtcatcccagtcaaaactggtgctctgttttggaagaagaggagagagaaattgggtagtggttgtcattagtgaagtgggtatttggccactatatttggttttctttcttctaggcagatggtacaacccttggggttagttaaggatgtgtaacttactttgatcaatgaaatgggagcagaagtgagatgtatcactttctagtggaagctttaaaagttggtgcataaaaagacacatgcacccatatgttcatcactgcgctattcatggtagcaaagacatggaatcaacccaggtgcccatcaatagtgggttggatagaaagaatgttgtgcatatacatcatggactactacacagccacaaaaagaaggaagacctgtcctttgcagcaatatggatgcagctagaaaccattatcctaagtgacttaacataggaacagaaaactatatactgcatgttctcacttgttaaatgagagctaaacattgggtacacatggtcataaaaatgggaacaacagacactggggaatacaagagaagagagggagggaggggggtcaagagtcgattaaaaactgcctattgtgtactatgctcctcttgagtgatggattcatttgtcctccaaacctcagcctcaaaatatacttttgtaacaacctgcacatgtaccctctgattctgaaataaaagtttaaaaaaagacagttggtacattgttccccaagttcttttccattgatgtgatgactgtaaaagcaaatgccaagagtcctccacgatgaacagagccctcttgccaaacctgtgataggcatagagcaagggtgggaaatagacttgtgtttagttaatccactgctatttttgtgaggtcgctattgcaacataacccagactatcctgacacaggtcggcaatcagcagtgtccacacatagtcctcaagcaaggtcatgatcagaccagggaggagccagggcctaagcctgaactggcataaacagtgccccaatttctccaaagtgaggactgtgccagtgggcctcaagacaagaattgggagtccacagctcccagacactggggaccccctcctatctggagctgcctggctgccacatatgagcctggtgacccagccacacccaccagctagctcatcagcagtgtccatgtcattatcgaggcagagaaatccactcagcgaggatttcccacgttagcccagcatccttacttctcgctcatagtaacagaaaccatgttcccgcctccaacagatgcactgtgctctgcactcccctggtcagcgggtgggtgcatgatgcaaactgggccagtcagatgctttcattctgaaacttgaatcttgagtgaaataagccagactcattggggactgattggaatttactcaccccggtggaggcacatggaagaggcccgttgggtcctgctatctatgtcctcagagcttcacttaccacagttcggagaggacagcacatcctccaggggttctgaacctgaatgcagcaactggttgagaacctgagttctgcgctgtcttctgttgcagtgggagtgagtagggttttggtggtatatggtataactgccttatcttgagaaagaatattttaacagctgtgtttatgtcaagaggggtatgtgtaacattcaacaaccaatgctgcagattgcagaggacatttgttgtttttgcctgctcagcatctattcttgctgcttctggtgacaaaattcagtggtcccatttctcttttaactccagagctagatttgatccagacctggccagtcagagcatcacatgctgcaggcctcagtgagtggttaggagctgggcagtggcctaccttagtttactatgacttgaacctggaatttgtgggcaacttttgggagccataataacagtaatggcagctgggctcacacctgtaatcccagcagtttgggaggccgaggtgggcagatcttttgaggtcaagagtttgagaccagcctggccaacatggtgaaaccctgtctctactaaaaatacaaaaatcagccaggcgtgatggtgggggcctgtaatcccagctactcaggaggctgaggcaggagaatcacttgaacctgggaggcagaggttgcagtgagccgagattgcgccactgcactccagcctgggcaatagagcgagcctcagtctcaaaaacaaaacaaaacaaaacaaaacaaaacagtaatggctagtacagttaacttggcactgtccttgttccttaaactcttgtccatggacttagagctgtgaggacataaacataatccaggagttcccaagacccactatgtagggagagcctggctaaaagagagaggtgccagttctgatgacatcatttaagctaggggctctggccaagcccggttaccctggactgttgacttacaagaaacagtgaaaagtccctttggtgcttaagccaatttgagttgggtttctgcctcttgaagtcagaagagtattgcctaatacaataattctgtgtaggcatacaagacacatcagtggtggtacctgccatgcccgcagccctagaggaggagacagccagcaggtggccctattttagatcatgtaacagttggacaagagcaagcaaacacctgactcaggctctgaatcaggctggtcaggatttgtgagttttcctctggcattaaagatgacctatgtctatccaatttctcttttttaaattggaagttgagaaacagggcaggagcgagacagccagctgcaagggaagaagcatgaaggatatgtgaagaggtgccactaggaggagctggcgtggtggcaactcagtttcaaagcagcagaaattcagcatcaggagagggcgccagttggtggaaagagctggcagagcacagtcaggaggaaacctgtctaggaagctccatgaagagagggagcaatggctatttctgaagttgtctcgcctattcctgaggacttttcaattctggttcaaatcctcatgcatccttataacaaacccattttttcccccaaacaagttgcaggtggtctgagaccaaagcagacatcccccttccatgttgcctctgtaaccctcccacggtgaccagcgtatcactaaggacacttttggtagcaaaggatggaaatataatgcaaattggtttttaaaaaaggaaatgtattgtcttccttaattgagatgtcaagggatgagactagccttagtcctcactgaggtcaaggctcccgggatgttctcgggaacttgcttctgcacatcctcactttgtccttctctgggcggctccagtatccggcttcatgtaagatggtggcttcatcgccacattcccttggggaatagaatgagtttctttctccagattcccagataaagtatttatcattggatctaagtggggtacacacttatcctgaacaatctctggccaggaaactgatacagtgattggctgaggcctagcatacacccctcctctaagacccacatgagcgtagaggaggtagagtgtgagtaatatctttgtggaatatatgttgaactgctggaagagagacttcaaataagattggcttaagcaagatagaagtttctttctccctcacctgcctgcaggtaagcagcctgggagcccaggtttttttttccccatcttgttgcttctctatccctaggtattgtgatgtgagatgtttcaccatcacctccactgcctagccagtggaaacggaaaaggcggaagaggagggctcgcccctctggttaaaagtgtcacctctccctacttcaatgctgctggtcagttacttggccaaatatagcttctaggaagtgaggaaatacagtattttttttctggatttccgtatctccagataaaaaacaagaattctttaaacataggagatgagtgtgatcgggggcaattagcaatctcagccccagcctgtcccattggccagtcaaatttccatgtgtcccctccccaggggagacaaccctaaagttgcatccagtgcctatgtccagctccaagcctgggacctgtggagggacagcctgcaccatcagatctgatgtggtttttgttttatttttgtttttttagacaagttctcactatgttgcccaggctggtctcgaactcccgggctcaagcaatcctcccatcttggcctcccgaagtgctgggtttacaggtgtgagccaccacaccaggcttctggatgcagttctttatggtgtgttgccccggaacccttacatacattgcctgcctccttacacccaatatgcaacagccagtaaaaataagataaacatggtgggaaacctcatccagaagagggaaaaacacacccaccaaatcctggtgggcagaaattgtgaaggctcccagggagtggagcagagtccttggatgacagcgcctctctccaggagtattccctgggatagacatctttggaccttggtggtcccctctttgtccactgccttccatggcacaactaaagggcatcaaacggtgtatccctcttagggctatacagcttaaacatttttttttagagagaaggtcttgctgtgttgcccaggctggactcgagtgcctggggctcaggcaatcctcccacttcagccttcagagcagcagggactacaggcacatgccaccacactgggcctgggctgcatagcttttgcagcccactttttgcaggtgcaggtttggtgggtaggggtcggttgatttaaggagtcaaaaatgcagacttgtaccagccagactcatggttctttggtaacacatgccccttaaaatctcagttggctttctgcctatttgtggctagttatcctctggggcaagtacaggttgggtatcccttatctgaaatgctcggggccagagtgtttcatatttcagattttggaatatttgcattatcctggctgaacatccctaatctgaaaatccaaaatctgaaatgctccaatgagcatcatgtgtgctcaagaagttttggattttagagcattttggatttctgggtttttggtttagtgatgctcaacctcctttagattagcagtatttaagcctaaaaatggtggccttttatttatcagcctgtatgttatatctattcacctccctctcaacctgagaccagcgaaaacactcaacttggactggaaggcagcttccttgatctggtctttgtggccgagcggctgtcattgtcaggttgagaaacgtaatcaagtgtttgagaaagactagggtccatagtctcgtctcctgctaatcctgcttcttcagaaaattattctatatctgcctcagtttgtggtacagaagcaatagatttttctctttatttttttaaataaatataattttattctaaaggaatattattatatggcaacactttgagaaccataaaggtgcctttgaaatgttgttagaaaatcacttaaatcatattttttattaataaattgatgccattttcaggcacagtatttttttgggcaagcactgtacagcataattcaaaatatacccatttacagaatccaattaggtatttttctgctcacaattatatgatggctgatttctgctcacaattatatgatggcggatttctgcctacattatgatgtgatatgatatgatatgatatgatatgatatgatatgatatgatggctgatttctgcctacattatgatatataactgctctacagaacatgaaacagaatttcataacatcagttatatttacactctactttaaaaatctttcaagatataagaatcaagctatcaaatatggagtttttaacaagcaatagtttttttttttaggtctgaaaactttttaaactgaggttatagcccataggcaaagggagcttctttcagcactgctgtattctcttcagtatctgccttcctcgggctagctctgtccacgttcttctgggtcatgtaggactctgttgagagtggcaagaagcatccagcaaacacctgcattctgaaatttccaactgtttcctttagagcaagagctgactttgcaaggtattgcaggaatcagttgatcgactgctatggcatggcataaacagggtttccagatcatcatatttatgtatagcatttaaaatatgttttcagttttgttaccagcaacacagcccttcttggtaataattagtatacagcctttactaataattagtatacagcactaataattagtatacaggctttccttctgcaagagagcactcaccccaaatagtgactgaaatagactggaggttaatttctctttcatggaaaacctagttagagctagtccagggctgataggcaaccacagtgtgttgggacacaggctccttctcttttgtcactctgacatccttagggttttagcttcatctgattgatataaactggcttcacaccatgacttcattcctaccaggggagagggaaaggggcgaggcacatttcttctgaagtgcatgaccgagaaattgcaaaaattacttctgctaacatctcactgctgagaacctaatctacagcatgttgggtgcacgatgcctgggaaatgtggtcattattctgggcagttatgtactcagttagaggaattctattactatagaaggggacaataagtattgggggacaattagcagtctctgtctcgggatgatcccccaaatgaaatgggggctggattgtggggagctgaaaaagcaacagatgtctactacaatgcctctcctctgagcactccagccccttctattcccttcaatccttgtgacctaattgtcctttgggcatctgtctcaggtcccctgaatcccccatcatgtaggctttggggccaaggcacctctgatttagcctatattgtcagcttgcagctgataattattattagggactcaggaaaatgtctgtggaactaaattgaggtagtaataggcatttctgaatcaactgccttccattcattcattcattcatccagccagccagccagccagcaaacatctattatatgctaagtcccagggagtcagtgtctttttgtcagacaaaaagacagccttttcatttatggctcttttggctagaggggtctcttgtaccctagagatattttgctagaaaagcagatgctgtttaactgaatcaaagctctctcttccttaggcattgatacatcccaacttagcatttcctcaaagcttgcacagaggctgtccccagcggtaatttgtgctttgggacagctcagtatcaggttcccttagtctggcaacagtgtcttgccctttcctttggggaaccactcttcactagtctctgtgacccactgtcagccctactgcagggccccaccattttgggaagagcagtgacacaggctggtcaattgaagagctctctctctggtccaggattgtcaagtaggggcagtaagacttgatttgtgggttgtttagatccagagatgtgaggatgtagatttaaggttgccagcaactttctttcccaagaggagagagactacggtacctcagtactacccccatcatttcttcttgctctgctattacataaagaagtcacctctttcctcctattgaactcctgaatctcagcccattgaggaccttattgccagtagcaattctggctcctgtatctcctgtccactccttctcaatgggtacttctccctagcagtcaaatgtgctcagttcgttacaatgtgcagtggatacttgtttctggtcactcaggcttcaacctccctgctggggaaaactgtcttgtgagcagtctcggtggggcagtgggtgatcctagagaggcattgggccaggtattcctccaggtatgtcgatccaagggcagagggcatgtggccatagctcggccaaacaaactgccactccactgggattttgaatcttgagctgagagacacaccaaggaccatggacaggaatcctttctgtggaggtggcactggggagcaagtggttcctcctgttgggatctggagtcacctggctcctgccttgaagaacatggctgaaagcattagcatctggagatccctgcgatcttttgacatatccccttttgcttaactttttttttttttttttttttttttttttgagacagactcccgctctgttgctaagctgtagtgcagtggcacaatttctgctcactgcaaccgccacctctcggctacaagctatcctcctgcctcagccttgggaacagggggactacagaaacatgccaccctgcccagctaatttttttttttttttttttgagatagagtcttgctctgttgtctagactggagtgcaatggcggtgcgatcttgactcactgcaacctccgcctcccaagttcaagtgtcctgattctcttgtcttagcctctcaagtagctgagattacaggcagacgccaccatacccggctcattttttgtatttttagtagagatggggtttcaccatgttggccaggctggtcttgaactcctggtctcaagtgatccacctgccttggcctcccaaagtgctgggattacaggtgtgagccactgcgcctggccatccctttttgcttaacttaaccagacttgctttctgttgtttgaaataaaagaaacctactacaggatgcagataataaaacaagcaagcaaacaaaaaaaaatagcattaaaaaaatgcctctcttgaccctacattccttcccaagtgacacctttcttctcccctttatggctgtgtttaaaagaggcatctgcacatgcaccatctctggttctctcctccagctcatcccccaacccacgccagtggcttctgcctctgccacctcactgaaggagcttgctccaagtgccctgtgtcaccatgatgtcccagtttcccactatcttttctgggtgctcctccatcctttgtcacctggtgactcacaaatgggtcctaagccctctcctcactctactctttccctgaagaccttatccacccctgtgacttcagcaaccaccccatgtccatgacacccagacttctgaaaaactccggtccttggctgggcatggtggttcacgcctgtagtcccagcatcttgggaggcagagggggcggatcacctgagatcaggagttcgagacctggccaacatggtgaaaccccacctctagcaaaaatacaaaaattagctgggcatggtgatgggcacctgtaatcccagctattcaagaggctgaggcggaagaatctcttgaacccgggaggcggaggttgcagtgagtcgagatcacgctattgcactctagcctgggtgacaagagtgaaattccatctcaaggaacaaaaacaaacagaaaaacccctccaatcctgtaatgtgcaacccacctgtccacgtggtgcctcaaacatcccagtgtgcccccgctggacccctgagtgcaccccacactcattcctcttctgtcagggttcagagtctcagcaaatggtagttggcccatgtggtcctcaggcctgagctgctctctaccaaagcaatctacacatatccatcccttccttcccccatgcagtgcagcttgtacctccaggacctgacccaggaggagctcagtaaatatttgatcaagtgactgatagcagcgataacactccacgggacacgttcacaaacaccctcttcccccagccctgttaggtaggtataattactaccactctgcagatgaggaaactgatgcccagagagatgaacagttttgcttgggtgtggggttgcacagccagtgaatatgtgggggagttgagattggaatttaagtgtgactccccatgctgggttctccctggacagctgccacagccaggggagcctccttgccagggcatgaatggaagaagggggccagttggacaaggagtgatgccctggggtgagggccagccagctgtgttcacaggtagattgcatggcagacatctcctgacacccagccccaagaaggcttccttgaaacacacagtgaggttcttggttcttgagatgtcctgggagctgagagccccaggtttggggcctggatctggcaccaactctcagtgtaaccacaagcagtccatcccttcttggggctcagctgacttcactaaagagggaatatgagtaagatgcctaagatgtggaagcagaggtcctaattcctggacaggggcagaagtgggtagtggcctcggcaaacaaatcccctatttgcctcctttaagcaggatccccctaccaggcagtgtgtgatggtgaggcccaagcctggggtctgacgtcgacacccctgtgggcatttggccaaaggcagccatctgccagaatctgagagctgctctcagacctcgctggagagggctacctggggcagtctgagtctctctgggcagactgaggtcctttgctacccaaacggggagaattagagatactgttggctcctgggcactggaagggaggaacgcaggcctctcagcacagggctgggccaacaagttgggggtcccggcacaggggacaacggagaagtgccaacattgggacccaattatgtgatactggggcccagagatagtacaggtgcctcataccacgtggccctgggtggacagcaggaatctattgcgagtggcgggaggccggggctgcctgtcctgcgccctgaagctggccagcggttgtggaaactgggggatattgagggaaccgtaggcccaggtcctcagcctcatagtgtggaacctggcgatcccagggcctgggctggcccccggcgtcacgggaccgggaaggcgctgtggtgctgcggggaattgcggagaagaaggcgggctccagtggaggtggctcatccccgcacggtcactgccctcgcccgctgttggggtccgcggctgggagactgaaggcctcaagtcgggctgggtaggggcacgtgggcagggaaaggggtggtagattaccagtcttcaggggcggggctggagatgcaaccctagggaaggagtctaccaggctgggctcttgaggggcaatggagggctccgggggccaggccaggccaggatcatggagttcaaaggactggagtgaggtttggggtccatgagagtggagctcagaggatgggacggtgggtccaggatttgggacctggggctggaaagtccgaggctagtggagaccaggcctggtatcccagacgaaagggccctataggaaacggggtctcgtgggcgggatctggagccagagaattgtgagaggcggagctaggatggagaaggcgagaggaaaggggtagccgccggcgcggagacctcaatgcggggcgtggtgcggagggggaactggagcgaggggcactggagcgagggggtggggctacgaggaggtggacttgaggggctgggtctggggccggagaatcgtggggagctgcgcctatacacccgggacggtggggttgcgtcggggaagtgggagtcttgggggttcgctgggcagcctggagaacaggcggtcgtggtgcgggcggggccgaaaagaccgaggacagtggggacccggcctgaggaggggtcgggaaggaggggtgggggcgcgcggacgcagatcccgggccgcggcggggcggtggcaggctccagagtggcacgggcccaggtgagcgaggtctccgcccgccgcccctcccgccgccccggtgccagctgccccgctggcccctccctgtacccggcgcttgctccgcgggccgggccgacggcggcgggcggcgtctcgcgcccaggccaggtcggctctggctccatcttgggccgcggcacctggcacctgtggcggccgcaggagcagcgcttcccccgcctgcgcggccccggcgggcgagagggtgagaggctggctccgcgcgctcccgttggggcggggggcgtggtgggcggcacctcccccttgctgagcctcagaacccactccttcccgctgcctgcgctcagacccccggcatcctggcccctgcccagcgcccagagcccccggtggccgcatcgcactccccgcgctccgcctctcattgtcctgtcctgtcccctcttctacgtctcctctgcccatcctcccattttcacaagtctgtccgggaccctgtctccttcggcctccacccctgctgccatcgctcctccctctccccttcttccttttcccctccctcagcctactgcgccgcctaccccgcccccagccttgctgccctttggcttctcctgtcccgcatcattaccccggcccacagccccatttgcctgcagtcgctgcctttgctcctgagaaggtctgtagcctcgtttcgggcccgtattgagcccccttctccctaagtccgggtgggctttgtgcaggaggggcgggaggggagctattctgggcgaggctgcgtggtgcggtgctttcaggcctttggccccgcagcaggggcggcctgtgcttggcgtgcagagtgcagctgggtagacgctgttactgcatacgggcctgtgtgtcccaggctggggcatgagtgcttgtgagcgtgcagatagggacacaccggccgcctaggctgcttctaggccggggcaccctctccacctaggtgccccccagggattgtgggcaaatcctccccaggggaggaagctcaggggctgttgggcgcctaggcctcttcctggtgagcagagcctcatccatggggccactgaccccacagttaccccagaaccctttcctggcacagcttgtgacccggggcatgtagcccttaaggcacgttcattgtgaagggcaggttttgtctcctccaaaccctccctttaggaatgctgcctgctgctttgcccagagttggccctgagtgttcctatcaggccccgttcactctggggtggattaaaccacctcctggagggtgctgtatccccactgtgcaatgggggtttgtgctgtgtgcattcctgcctggtccttgagaggtaaggtccatattttaacatagaaccagttttcctgcctgatcatataggtttgcttttcctgttttggttttgccggacacataagtcatcatccaaatgcttgccacttaactagaggggacttgggccaggcgctgtggctcatgcctgtaatcccagcactttgggaggccgaggcaggtggatcacctaaggtcaggagttcgagaccagcctggccaacatggcgaaaaccccatctctactaaaaatacaaaaattagctgggcgccgaggtgcacgcctgtaatcccagctgccgggagactaagacaagagaatcacgtgaacccaggaggcagaggttgcagtgagccgagactgagccattgtactcgagcctgggagacagagcgagactctgtctcacaaacaaacgaacgaacaaaaccaagaggggacttagatggatgccacagtgttgtctgagatggagcccacttgtggtggtcttggtagtcccctgggcatatcccaaaggcctgggctcctctgctgtggcagcatggcgggagctggactctgtacgttgactcaaaggtctctatgtttgggctagtctggaagtgtctgagaactgggggcttttactcaaaatgacattggttgattgctacataggtggttgatcttccagttgctgacaggtggaacctgaggcagcaggacagcctggcattggccacgggacatcggccacaaccatagcaacttcggcatcaaatggggcaggagagagaacattaaggtatcgttcaaagaatactagaggtcttggatacttctgtatgcctgttctttatcttgtcctaaaagatcttccgagggtccctttagggcaaaaccagaaccttctgtgttgttataaaggcagggtgggtgtgccattctgggcatttaaagtgcagactctagacttgtatgcatgcgtagcctcctaggttaacatttaaaataggctctgggaaacctagtttggtgatagggagactggggacactgatggtgacctggtcctaggatgggatgaaggtagcgaggatgggaagctagaggaggctaacctttggggtgtcttgatggcttctgaaaagggcctctctggcccccagtactaatacttgttataccatgaacttaagctgctcttgatgggaggggaaagagaagattattgttaacaaacactattgcagacagtgcacatgctgtcacatttggtcttcacaacaaccctgcagggtggggatttatttctgttttgcagattgaagaaactgaggctcaaagaagttaggggtccacctgtgagtacatgcacaggaaggggaagagcccccattggaagcagagccctgccccttcctcctcacccctggctccctgggaggcccctcctctggcccagtccacagcactgtgacaggcagtgtggaagcctctttcccccagtactcccctcagagcccttccttccttctgagctgggaaggccaggttgtagttagccaggccaatccattggggttctgaattagccactttcagctgtgtgttctttgacatttctgagctgctccaggcctcagttttgtcacctgccacttgtggagggggaatggggaagggaaccaatagatacatagcccacacgggggtctctgggtgatgactagccctgggtgctgggcagccctctggtgagacaggcacagtgggatgctcattgctcatggcttctcagtgggtcttggtgggggtctgaggacctcattccacctgtctcctcaggggccagaggctgctggcctggctgtttatggcccccctccctgggagggtggtggggtttggccagaggctgtgtggatgtccagatggggcctccctggggtcttggacctgcaactgagtggttgtctccctgccaggggctggcagtgaccacagctgtcccagtcaggaggaacacctcctgccctcctcattcttgcagcctcaggagctgctaagaagcatgttgggcaggtggagatccactcagtgacttgttccatggcatgtcatgagcacgattggcagggccaggccagatcagtaaaaagggtgagagctgcgaggcataggcctgctcagtgctcgaaggggagaggagctcagctgccccacaggtgtgtgcccttgggggtcactgagcctctctgagcttatggaattctcctgtctgtagaatggagataatgactgtctcaagaggttgcttgcacagttatatgagacaatgtatgcaaaggatgtggcacgtgtctggcccttggcgagtgatcaggccctggcagctgttattatcatcgctgttacgggctttattgccctcctttgtttgtatgtccatcttagagctcattgagggcagggtctgggtcagatttctctcttggctactcctcctcttcctgatcctcccagggacaagtctggcttcagccccgtgaagcagctgggatgggacatccttaccaggccggggctgtgttcagagctgcacagtcctgtacggtagccattagcctcatgtggccagttagattcaaataaaacttaaacattcagtgtctcagttgcagtagccccctgctgagtgcttggtacccacatgccattggtgcctacctattggacagcacagggtagaatctttccatcatcgcaggaagttgtgcagagctggagtctcagggactacagcaccagtatcatcctcactgtggctcagcagccaccagccatctcctgagtgctgggctgccaggacatttgtaattacacagaaaccgagtcccacagcccttcccgaatttcctctcgggtagccttgctcacctggtcggggaggttgttgcctggaagtctttatcagcctaggctgggagggcagggctgggattgcccaaatgcagctgctgcctcctgtccccaccctgtttctcccacctctcctgcctggcaaggagtcccagagtgatctccctaattcactgctgtggccagggccgaggtggcccagacactttgaccccactgctcccctcatatgctctggacacatggcctctttcctcctgcccactccgctctccacctgaacaccttcttgcttctctcactccaggcctgacttacgtggctggtcctccaggaagccttttctcatctctcaccctccgtgagctctcctgccttggtggtgccctccctcagaccccatttttggcactcagtgccctcctctgtgggtgtgttcttgtatttgcttgttctcttggtcaggcacacagcagataatcctctgagtgccgacgacacatcaggtcagtgctgggtgttggacagccagaggggagcaggccacaggccaggctttgccaacttcaggcctgtggggaggctgacagttggccaaactgttccatgcaggcccaatgctcagtcagggatgaaggctgcctggctggagggtcgggaaaggggccccaggaagagatgcagaagtggaaagggccagaactggctctaggctgcagctgccaggtccagggtggtctttatggctgggggaagtgacagcgatggtacggagggtgggggacaatgaggatgcaggtacactgggcaagaggggattaaatgtcaggcaggataggtctgattgatggtactgggtgggcatcttatctcactgctgcaccgtccccaggggtacagaaaggtctgaatgaatcccatgttccctagccctacagctgggcacgcagtaggggctcaggagatgctgtggaatcaatgaccagatgctgaatgagtccctcatggaaaaagctgatgcatggggcctctccttgcccctggagctagaggtaggagtcagggaaccccagagacatgccagctcagcaaggctaggccaaggaggatgggggtggttgtggaagcccagggtgattctcagtgtcctctggtcattgctccctcgtcctgtgaactttctctgagctcccactctgtaccaaggagaccctgtccacagtgagttggatactgccagtcccaggaggaagtagcccagtattggcctgtccagctgtgcccgttaagaggccatagtgcttccgtgctggttgaccaagagctgttatcccacagccccaccccctagggctgcagtttcacccccaaagccccagcagatttggctctctcccttcccctcccacacaaaccagccagtaaagagttgagagctgatagagtggcggcctccaggaccccaccctagggcagattctaactgcttgagactgatgatgagataatttgcagtgtcatccttgtgtctaatgtgagatgaccttgatttgaagtgtctggtgtcttgtcactcactgccttgcatatggttctgaccagtcaggcaggctgggactgaaggtggctccctggtgaacctagcactgtgggagttcatagtagaatcggcttaggtgctgccacccaactcaactccactccctccctttctctcttctgcaggcagccatgagctccagccgccccgagccgggtccctgggcacccctgagcccccgccttcagcccctgtcccagagctcttccagcctgctgggtgaaggccgggaacagaggccagagctccgcaagactgccagcagcaccgtgtggcaggcccagctgggcgaggccagcaccagaccccaggccccggaggaagaggggaacccgcctgagagcatgaagccagcacgggcctctggccccaaggcgcgacccagtgctggaggccactggtggagcagcactgtgggcaatgtgtccaccatgggcggcagtgacctgtgtcgcctgcgggcccctagtgctgctgctatgcagaggagccattcagacctggtccgtagcacccagatgcggggacacagtggtgctcggaaggccagtctcagctgctcagcccttggcagcagccctgtccacagggctcagctgcagccaggtggtacttctggccagggtggccaggcccctgcaggcctggaaagggacctggctcctgaggatgagacttctaactcagcctggatgctgggggcgagtcagttgtcagtgccaccactagacctgggggacacaactgcccacagcagcagtgcccaggctgagcccaaagctgctgaacagctggctaccaccacctgccatgctctgcccccagctgctctactctgtggcatgagggaggtgagggctggtggctgctgccatgccctacctgccacagggatcctggcctttcccaaactagtggcgtcagtgagcgagtctgggctgcaggctcagcatggggtgaagatccactgtaggttgtctggggggctccctgggcattcccattgctgtgcccacctttggggtcccgctgggttagtcccagagcctggctctaggaccaaagatgtgtggaccatgacctcagccaatgacttggcccctgcagaggcatccccgctgtcagcccaggatgctggtgtgcaggcggccccagtggcggcctgcaaggctgtggccaccagtccgtccctggaagcgcctgcagccctgcatgtgttcccagaggtaactctggggtccagcctggaggaggtgccgtcccctgtgcgggatgtgcgatgggatgctgagggcatgacatgggaggtgtacggagctgcggtggacctggaggtgctcggtgtggccatccagaagcacctggagatgcagtttgagcagctgcagcgggcgcccgccagcgaggacagcctgtctgtggagggccggagggggccactgcgggctgtcatgcagtccctgcggcgccccagctgctgcggctgctccggcgcggcccccgagtgaggagctgtggcccttggagctggcctgggcccactgacttagtcctagacctgggccagggacggtgggggctccgtgccccctggacccaccggcagctgggcacatctctcacctgaatattggctgcctccagaccacaggactgcagcctggggcttccggccctacacagctgggctgttttcttaagggcttgatttccaagggccacatctctgcaccttccgggctctgaactttgagacagggctttagcactgtgcagaggggagatcctgagttttctgtaaaaaatgaccttttgttcactccaccctcagaactctgccatgttgcctcgtcagactcttggtggctttatttgaaatcagtgctgagaaatagtgaattctcgacatgaaatgtgaggccccagtgacagggactgcccaggtctttagggaaggggactgatgttatcagaggcctcctgtgtgccacatactgtgcttgtcctgtcttcacctcttcatcctggcaagccttcatttggcaaggctgtagccgatgtgccccacgctggacagcttgaagaggtgggactgagatccaaagccagggccagctgagccgtgggtgttgccctgtagcatgtgcccggtccagtcagtgcagtcatgtatgaggagaatttactgagctcatactctgtgctgggttctgtggattctgtggtgaatgagacagaggctgcccctgccctggctgagctcatggtgtgggttggggatggcaggggaggatgctgaccattacggagggctgccaggcttccagggtcattgtgtcagaggctggcctgaggaaggggagaatgggtggccacctgccctaatctcagttacaaagcctaaaattgcactattttcacctcattctgtcggctgaaggatttctccccagctggtgcagtttgtggaaggagggagggcaggaatggagggggacagggcaggagtttgccctggccctggggtaggggctgtgaggctgtgggggctcgcttgcccacatgacctgacctaggctaggcagtgggggccaggggccttggagagacagaaacatgggctttggcacagtctgacttcattgcccaaagatttctcgaggcctgtgaagaatgggagtgggcttgtgttcttgtcctgggtctttgtcttgaagatcctaagatcccgtgacacagccccccaatccacccgtgtgagggaccagagggctagtgtggggtcatggcccacgacctggcctgtttctggagcctcttctgcacctaggagcccaggacccccacagtggtggcttacttttccccatcctcaaggacctggtactcattgaggtggaaatgactcatgcaacagttggtgaatttgtaaagcaggagtggcatttcaacaggccacaaggacaaagtgacaaaggcgtgcgtcaggtcagatgcctcctgaagcccaacgatggaccattctcacccgtaaacatgcctttcccatatgcataggtgcaccccttgggattctggggctgtcagtccctttgtgtatggtgccagggcaggcagctcacgttctggggagtgacacatgggtatatgccatcttcatgcctggctccccatggagtctccaggaaccccagcctgttagggccacatgagagagaacaaatggctgtgggtgcatggggagggacctttcacacagggccatagctaagtagggtcttgaggatgcaggggttagacaggtgggtggagagagggcaggacctgcctggcagatggaacagcctggtcagatacttggatgtgcctgtcctgcctgggccataatgagtttctgcagtggcggctcatttggagcgtttgttgggttgggaggtgaccaggggtccccattgtgaagatcctgatgtaaatgaggaaaggaactttaagggaactgtggaaggggttctgaggtgggaccagatttcagtttagaaatatccatttggcttccagtggagatgtgccaggtgacaccaaggaggggcctgtttaggggcaatggagtgggcagctgggggctgggttcatacacgtgcacacacacgcatacacaggcacacatgtgtgcaatggatttggggaggaggcatttcaggatgctgaggtttccagtttgagcaagaggagggtgaggccactacctgggtcaaggtgaatggcatgttcagcaggtgcagaaagggccacctgccacagggtttggctgggaccagtgaaacctacttcatgaagagactttcttctgtgtcacgtgcagattcttatgcattcacgctggctgggtgccactctgtgctacctccatgctgccctggcttgccaggatggcaggccgggctgggctcagccaagctcccactcacctcatcgtcactgagatgagtatttgcagagcggtgctgaaatccaacacctgtgtcttggctggggccccagatgattctcctggctaaaccacgatccttgtctccctagcccagttgcacagctgctgctgacaggtctacctgaagtgactgcagcctcatttctgattggaactggagacccctcccaaccccctttgctgtgccctctcctggaacagccctgatgcctgcagtggtttagggccccagagcatggccagcggtttagtttacagatctcctccccttggactctagatttctggccagactttctgggtccctttcaggccctgctctgggaggtgttggagttcactgttgatgtgtttgtttggctttgaattcaaaacagatacaaatttggaggtgagagctttgccagaccccagcagggatggggcatcggtcctgactggtcttgtttattttgtcctggtaaattctgttctttggagcataaaccctggagtcctagagccccttgcctcagcaggaatcccccctctgtctgctccaggggctccctgcttctgcccacctgctctccttccatggcattcaggacccccgacagctgaagcctctcttcatatagcttgtcccctctgggcctgcctgtcttgtgtccaggacacaagacacgcatcccttgtctggccccaggctgccatcactgtcacaagaaactcatagagtagagctggtctgaggtcacagtgctggtggtggtggaaaagcagggatggcctgttccactgtgatcttacctcctgtgtcacctggattgggtctctgtccccttagacatgctagatcctaactttacaagggctgaaggggtcttctacacgcaggtcccaacactttgggctggggttggccaccgtagcttagtgggctaaagctggagtttgaatctggatatataggatccacacctatagccatgtgatcttgggcaagttacaagccttgatcatcttcctcatctgtaagatggggatgacaatggtgcctccttcacatgcttggtgtggagattaaatagaataacccaagtagtgcctggcactgagttagtgctcagcacacaggctggtagtgttgggcacccctctcatagccacattcaggggccacctcttaccctgccagcttggctgtgatcacagcccacatcccacttccttaaaagtcccttgttcagagcctctttccaggttcctcgccccacagctttgcaccctgcctgggacttggccctctggctggggcttctgaaaatgtagttcccagagtgcattgaggagggctaccctagccctcaccactcatcttgggctgggttccccagaagcttctgctgagatgaggatgctggagttattagggaggggagagcaagttaagggaggggcagaaggcaaggcagggtgtgatttcagtccaagtcagaccctaaaggggagccctggatgcagtcccacctcagagtaaggactacccaggggtgaagatgtagcctccaggcacttctgctctctggcaggcaggctaggaagctctaggagccccagggtaggtttctgctggagtcgtagggcctattttgggggaagttgtgcacagaaaccaccagagggagtcacaggcatctgggggtgcacccattgacatttgcatccatgtcatgccaagcttgtagcccacaaatgcccaacccttttctccatgcattgctctgtctcagttttgttcacgccaagcagccttggttagttaaatgcagagcttggcatttgcccatgttaaattccttctcctttttcattctggcctggcctggttttgccatctgaagctatgacaagtcctttatcagttttcatccaacttgtcaggcagggcagggctggtatgaagcccaggacatatcactgggacatcccataggtctgtgagattcccaggtccctccaaatccacacggtcatcatgggcaaattagtttaagtctgatctgttaagatccagatctctcacaccaacagcacacacccctttttcccatggccatggaaggagggtagcatagcctgactcgagtcctcgttctcagcagaactggttctgtggtggccacttccctttctcaacttttacctacttctgtttaataggttgttctgcaagtctgagagcaacagcaagcttagaagtgtggactcagcctggtacagtggctcatgcctgtaatcccagcactttgggaggctgaggtgggctgactgcttgagctcaggagttcgaaaccagcttgggcagcatggagaaatcccatctctacaaaaaatacaaaaattagctgggcatggtggtgtgcatctgtagcctcagctactcagggggttgaggtgggaagatggcttgagcccaggaggtggaggttgcagtgagccgagatagtgccactgtgctccagcctggatgacggagccagaccctgtttcaaaaaaagaaaaagacaagaaagaagtatggactctaccttcttgcccttgtggagattgggaactgcctgcccttggcctctttcctgtccatcttgtattatgaaaggctgtttctggcacacccgggctcctctgtgtggtttctgggaagtgactgagggtcaggggaatggagcccctctgcagccggccgctggtaccttccctattgaacccttctttaggtttgctcactctttttgatgggtgtctttccaaagctggctggggacctccctgattgagagacatggggccagttctgttgctgtggctacacgggaataataaagcagaagaacacctgaggaaagctgatgtttactaaaaaaaaaaacaagcgaaaccaaagtgacgtgggcccataggattggggatgggtggtggggtctgactgccttgtcccaagagttgggtgaatgccgcctttgctcacttgtgcggtcactctccaggactcctgcctggcttctcccactccaagcccgagatagcccagcaaggaggaaggtctggccccaaaatacgagctccccaagtggatatcctaaaattcatctttcatggccctactttattgggagggaatgtgaaaattgtgggaatatgtccattgacatctggggctcagggcaggggagtgtgtctagttttaaggtgtgcgcttttagccatgcagtcatcgcccagtctgtcctgcctggagcttttcatttccctgcagctttcctgagaaaagacagagtgtgctttctctgcatcctatgaacatggccccaggactgcagcacctctgtgtgcacacagccaaggacagtcgggggacctctgctggtcctgcacccgctgccctgggtgctctgtcatccccatcccccatttctctttaatctgttcttcttttgtggtttcatgttctctttgttctgggttattcagaacctgtctgcctccccactgtccattgtacttgttcctgcctcctcctgctttgtgccaaggatttacttgccttcgccttctggctccatacagtagtctctcttcttgcggtcttggccattccccccaccaggcccccagctgtggctgtgtctgggtcttggcatttgtgatttacatgggtctaggccctttctctccacctgtccttcccctctttggacacaaaccaaaacatctgagcatctccttacagagggaggtctccctggggttgctgtgccaagtttccattgcttttgcccagaatgagaaatcagttgtcagtggccctgctgggtgaatggaaggactttggtcgggctggaagggcaccccatcagtcctaacttttggtggcccttgttggtggctggctggctaggctgctagagaggtacatcaggtgggtggcacccatctgctggctttaggcaggccatctcctcatccatgttttcagaatcttcttgcatggcttgtaattgggttggggtgtggcctgagcccctgtggggacacactgcactgtcccacctgtatgcttctctgctgtcaggaactggattcgtgtccaagagccaaggctagggactggaggaggagatttctgtctttgacccctccatattagtccattttcatgctgctataaagaactgcctgagactgggtaatttataaaggaaagaggtttaattgactcacagttccacgtggcccggggagcctcaggaaacttacaggaagcctcaggaaacttacaatcatggcagacagcgaaggagaagcaaggcaccttcttcacaaggcagcaggaaggagaatgaatgcagaaggaactaccaaacacttataaaaccatcagatctcgtgagaacttactatcacaagaacagcatgggggaaccgcccccacgattccatcacctccacctgatctctcccttgtcacatggggattatagggattacaattcaagatgagattttgggtggggacacagccaaagcatatcaccctcccaggcctgagcaaggcccaagcagggagcctctgttggggctggaaccctgggaggggtagaattctcccctccactcagatttgttccctgttgctgcccacctggcccctgccctgcagccttctgcctggccttctctctgttcacttctcatttttagcagtcaacagactgggagatggtggccaagggtgtcattttgtacacaagctttgtggcttttgtaagcccagcctgcaactcttgaggaaaactctttggtttgattttttttctcttcagagttgggggtattcagggagaggggcaagggcttcttgtgaagatttcaattcttgaaggtgtggaagcctcctgggctgggggaaggggtggggcaggaaccagcaggggtgtggacacaggggtctggcacctgggataccgtaggacagctgggcaggaagtcggatgctgctttattgaaatttttgatattttatcattttttcattagtttttattttaaaacactgctttaaaataattaaaatatgatttatcttggttaccgaatcacttagtgttgccttaaattttgcgcctagtccctgcctgacctttcctcctcctctcccagggctttaggtactcttagtccctgtgtcatagggactgggagcagataggcccctccgcccaccccacccctcccccacccctcgcccacccctcccccacccctccgcgttcctactctaatctcctaccctgatctgcggtgcagggcggcgctggagagggtggcttgcggctgatcccgcggtctggtttgcggctaggtgtgtgtccccggactggcgtgggtcccgggccaggcgtggtcctgggcggcgcggcccgtgacaggacccgacgcctcctggtgggcatttcgctccaagccgggaccctcggagcctgaggggattcgggagggaggagtcgccgtggggcggggcggggcggggcgggggagggctcccaaggccccgaggacagtcccaccctcaccgacaggaccgtccctgcgcatcccccacccttcttcatcttcgggcgctcgggccaacctggacagcagggcggaagcttccagaaaggacagagatggagaaggtgggaagggtggggctcaggcaggggacaccacggccttaggaatggaagacaggccccacttacctcttcgactccagatgcagctcatcctcacgaggggctggatgaagagggcttcctctctttcccccctaagctgtgcctctgagcctctgtgcaaatatggtggtgcaaacctttggtctgccttcatcattttgttgttgttgttgttgttgagacggagtcttgcaggctggagtgcaagtggcacaatctcgctcactgcaatctcagcctctgggttcaagcgattctcctgcctcagcctcagcctcccgagtagctaggactacaggtgcgcaccaccaggcctggctaatttttgtatttttagtagagatggagtttaaccatgttggccaggcagctcttgaactcctggcctcaagtgatccaccctaataaacttgctttcactttactctgttggctggctcttgaattccttcctgggtgaagccaagaaccgacgtagcctcccaggctgaacctcagtttggggctttaccccatgacacccgcaaagggctgggcttcccttcttcttggggagagggtcaaggaagtggctgtatcttgaacacccattcctctttccttccatgcgcacaaggcctctctgagctgctgtcttccttaggacactttcagctacaagtaagttaattttgaactgaaagttagctaaacaattattatagaatgttcaccttcccactgaagaatttaggaggtaactggcttctgggtgggctgtgtggctcagtgtggacatggattcaggttctttccatatttgtgctgtgccatctttagagcgtagtgaaggctgtccttagccccacgatggctgctgcatttcaactctggaattcagttgctggaattcacactccagtctgtgtgactccagggcggtcattttgtttgtcttttcaaaaatgaaagtaatacgtacttatgataagaatttaaaacagtacagacctcggccttttgttttattcatgataggaatttcaaatactgtgtaaactgaaggtctgatcctcgcccttgtctggaattcccgcagattaccactgaagatgttaataatttccatgggccttccacaaacttccttggtaatcacaagctcagacctctgaatattccatacaagtgagatcccacttagatactattctgtattaattctttaagataggccaggcatggtggctcatgcgtgtaattccagcactttgggaggctgaggtgggaggatcacctgaggtcaagagttccagactagccaggccaacatggtgaaatcctgtcgctactaaagatacaaaaattagctgggcgtggtggcgggtgcctgtaatcccagctacagtcaggagaatcgcttgaacccaggaggtggtggttgcaatgagctgagattgtgccgctgcactccagcctgggcaacagagcgagactctgccaaaaaaagaaaaaaaaaattaagatatgtcttgtagataatactgccacatataacaatattttctttattttcttcctgggcatattgtatggcatagtatacaagtgccttttaaaattaaaccagacttctttttctggactttatgttacacctcacattttttttaacttaatagatttatttcttagatgagatttaattaagagaaaaagtatgcagaaaatacagagttcccctacactttctcactctcatacactttctcctattatgagcttgcatagtgtacaacatggtacatttgttacaattaatgcaccaatattgatgcattactgtttcctaaagttcatggtttaaagtttactctttgtgttggacacttctctggattttgaaaatccatgtggtgtatctcccactccagtagcatacagaatagttggaccacctaaaaatcccctgtgctccgtccattcacccctcttaccttccccaggactcctggcaaccactgatctttttactgtctctatagttttcctgaatgtcacagagttggcttcatgtagcatgtagccttttcagacaggcttctttcacctagcaatatggatttaagcttcctccatgtattttcatagcttgagaactcatttctttttagtgctgaaaaatgttctgttgtctgggcatactgccatttattcatctaccaaagggcatcttggttgctttcaggttttgactattatgaataaaactactataaatattcatgtgcaggttttgatgtggacatatgtttacttcagttggttaaatacgcagggcaacattgctgtaagactatgtttagcttcataagaaactgccaaactatctctgtacaatttcgtattcctactagcaatgaatgagagttcctttttctcatataaaaataaatatccttgtatgtatagttttatgttcaggtgtgagtatatctgtaggataaatttttcatcaagtggtacatgtaaaatatctaccggtattggcaaattgctccccagaaagattgcaccaataatacatgaaaacgcatattttctcatacccacgccaatatttgattgttaatcgaactttaatattttggctaatttgataagtgaaggaacaatgtcttcctagttattgtgatttgcaatctgttccctgtgagtgaggttgtggtctgccggactgcgtgagtgagaattcctgttctggcactctcaagctgtgtgatgctgggaaagttgctgaacctccctggacctcagtttcttcatctatagaatgaggatggtaatgggtctttaccttattaattggattggaggatttaatggcatcattcatgtaaagtgccagcacagttcctggctcaaaataagggccaagtaaatgtaagctattattattctccaatatgttcataagcacttgaatttcttcatttctgatctgcctatgttcatatcaatttcccaggattttttcttattgattggttagagctctttgtatattaataacatacgtttatttttttcatataagttacaagtatttttttattccagtgtttcatttgtctcctgtttatcagatcctggctccaaaccagtgcaacatccttctcagggacacagcattttaaatcttacaaagcccctcatttcccatctgtcatttatgtctcaggacatccacatgaggcaagctgatgtatttttcagtaaagaaggagactttattgaccaggcagggcgagtgacttgcctaagggcacagaaggaattagtggtttgtacagactgaaatggagggtcctggcccctaggtaccacctcctccactcttaaagaaggggagagggaatctggaggtgcaggaaggaaaaggtcaaggtcatcatgacagacagcctcaccccatcccctctcagaacccaagagcctgggtccttttttttctgttaagttctgaccattctctcctgataaatcaagggaagaatgcgagtaaagggtatgtgttactcgggcgagactccctgcttggaaggtctaggaggggaggtatgtgtgtgagtgtgtgtgtgtgtgtgtgtgtgtgtgtgtgcattctttctgtcaagttgcccagcaggtgagctgaaagctggctctcttaacttggggatgagcaatagagtcaggtctcggttcgtcattttccaatttcatcagctttgaaaatattttaataataaaatccaagcatttgattttcctgactagttgtttattctgatttattggctatgcatggtgcctgaagctcctccaaactcccaagggtatccctgcatgtctcaggatgtctcttaacccagtgccatgtgagggacagaacctagaccaggcattcagagccaggtaccattgtgcctaccctactcactgctagatgatgctagtgaggtgctcacacctctctgggcttagtccctccattgtaaggcaaatgggaggcctgctgcctctgccttgctgggttgttggtatggctgaaatgaggggatgaaggtgatgtggaaaacttgataggagagtggctgccgtgtgtccattctggtctcctttgtctcatgtcaagcccagggactggttctttttctctcttcgggtctgtgacttctgggaatcctgcttgcctcggtgccccctggtgaggtggtgccatataggttgctttagcacatcaccgagagggactctccaaaccctatgctaagtgttcaccgccagaacacttgcatttgggccagaccgggctagggtacctaaccatagcttcctgggttcatttcacagggtggacagcaactgagagatgtccagggaaatttccctttttaagagataggggttctggggcccataagggcaggaagtatccccaaccacaggcaagttcatgaagcccatagggagtaggatggagccagttgccaggagcagggaaaggttcatgtctttgctcctccatgtacccagggactcagcaccacctgcaagttgatggaaaggcagaatctcagcacactctgagcccccgaatcagagtctgcattttaacagaacccctaggtgaggcagaagcccactactccagtatcattcattcattcactcacctagcaaacatgcctgaggccgactctgtgccgtgccctgtgctgacgaagaccggccaaaagaccttgttctggtcttcctgaagctcaggtggagcagacaccccaacggccaacaaatgtgaagattgagaactgtgatgggagcctgaggtgggagcagctaagcttccctggggaattgggggtcagggaagtagtcccaagaggctgagtacctcctgtgtggcaggggcagggtggcctttgctccctagtatcttttttttttttgagatggagtctcactctgttgcccaggctggagtgtagtggcgctaccttggctcactgcaacctccgcctcccaggttcaagtgattattctgcctcagcctcccaagtagctgagattacaggtgcccgccaccatgcgtggctaatttttgtatttttgctagagacggagtttcgccacattggccaggctggtcttgaactcctaacctcaggtgatccacccaccttgtcctcccaaagtgttgggattacaggcttgagtgactgcgcccggcctgtgctccagtatcaaaacctgcaagcacctacagagtggagggtgctatggtcagggtggtgctcaggtccagactgatggaggaacctgagcaggggcggggaggcatttcaggaagagggagcagttgctcctgcacaattttgttgcatcgggccaagcaggaaggctggagaggtgaggaagagccccgggggaaagcatggaccatcagggaaaagtcagacattgccctgttgctaaaggcactcctggatgggttttagcccggggagacctgaatcaaattagggtgcatagaaagaccatgatatccccttgatggggaggagaaagaggagaaacaggaggactaggagggaaagccgaggcgatttgactcagcatgagtgagatgtggggcagggagagagagagagagaaagacacaaagagagagacaaggagagacaaaggggagagagagaggagagagagagagagaacagagagacagaggagagaaagagacagaggagagagagaggggaacagaagaaagagaggcagagagacagtgaagagagagaaagagagagagattgagaaagaaactttgcatccgcaggcctgggccccatgcagcactgacagtggtaggcagccgacgtgaagcaggaggcacaggcagggaggatggacacagcacctcccacagcttctgagtccttggtgcagaatgtttatggcacttttcttcgttctttcttaagacttatttagtactcatcttttctcctttactccattgtgagcttcccaatgataggggcactgtctctctcatgtctgtcttcccacattgcttatatctaggatgggaaatgcaaggctcccaggcaatgcttagttaaaggggcaaagggctgtggtcttgtcttaagtctctgccaggctgaatgcctagaacttggccctcaggagggcctgagtcactgtgggacacagacttttaaaaggtgaaacagccaccagccaggggtgaggaactaacagcagacacattgcctgattttaagatgtactataaagctacagtaatcaactaagtgtggtattggtaaagaatagacatagatcaatggaacagaatagaaaattcggaagcagatccacacatgcacagccaattgattttcaacaaagatgcaaaagcaattcaatgaagataatcttgctaacaaatggtgctagaaaaatagaatacccatatgcaaacaacttatttatttatttatttatttatttatttattttgaggcatgtcttgttctgttgcccagactggagtgcagtggcgcaatctctgctcactgcaacctccgcctcccaggttcaagcaattctcctgcctcagcctcccaagtagctgggattataggcgtgcaccaccacgcctggctaatttttgtacttttagtagagacaggattacaccatgttggccaggctggtctcaaactcttgacctcaagtgatccgcccaccttggcctcccaaagcgctgagattacaggcatgagctaccacgcccagcctatttatttgttttctttgtataaatttagggggtccaagtgcacttttggtacatggatgtattgcatagtgtgaagtcttggcttttagggtggccatgacccgaacagagtgcactgaaccctgtaagtaacttctcatccctcgccctgctcccaccctgctgcccttctgagtctccactgtctattatgccatgccgtatgtccatgtacacacattatttagctctcacttgtaagtgaggacaagcagtatttgactttctgcttctgagttattgccttaaggtaatggcctccagttccatccatgttggtgcaaaagccattatttcattctttcttatggctgaatagtattccacggtgtatgtgtacacacacacacacacatctataaaatatattttctttacttaatcatctgtcatatacaaaaaagatttatcttgattcatacttcgcagcatatataaaaatgaacccaaaatggatcacaggcctaaatgtaaaattgaaaactaacagatacaaacaaagaagaaaatgtgtgaccagggttgggcaaatatctcttagatgtgacacaaaagcatggcctacaagagaaaagtgaataaactggctatctttttttttttaattattattatactttaagttctagggtacatgagcacaatgtgcaggttagttacatatgtatacatgtgccatgttgatgtgctgcacccattaactcgtcatttacattagatatatctcctaatgctatccctcccctacctcatcccacaacaggccctggtgtgtgacgtcccccttcctgtgtccaagtgttctcattgttcagttcccacctacgagtgagaacatgcgatgtttggttttttgtccttgcgattgtttgctgagaatgatggtttccagcttcatccatgtccctacaaaggacatgaactcatcattttttatggctgcatagcattccatggtgtatatgtgccacattttcttaatccagtctatcattgttggacatttgggttggttccaagtctttgctattgtgagtagtgccgcagtaaacatacgtgtgcatgtgtctttatagcagcatgatttctaattctttgggtatatagccagtaatgggatggctgggtcaaatggtaattctagttctagatccctgaggaatcgccacactgtcttccacaatggttgaaccagtttacagtcccaccaacagtgtaaaagtgttcctatttctccacaacctctccagcacctgttgtttcctgactttttaatgatcgccattctaactggtgtggtggttttgatttgcatttctctgatggccagtgatgatgagcattttttcatgtgtctgttggctgcataaatgtctttttttgagaagtgtctgttcatatcctttgcccactttttgatggggttgtttttttcttgtaaatttgtttgagttctttatagattctggatattagccctttgtcagatgagtagattgcaaaaattttctcccattctgtaggtttaaactggctgtctttaaaattagaaacttctaagctgggcacagtggcttacgcctgtaattccagcacttggggaggccaaggcaggaggattgcttgagcccaggagtttgagaccagcctaggcaacatagagagaccctatccttataaaaataaaaaataaaaaaattaaccttgtgtggtggcatgtgcttgcagtcctagcaacgtaggtggctgaggcaggaggctgaggtgggaggatcacttgagtccaagaggtcaaggctgcagtgagccatgattgtgccactgtactccagcctgggcaactgaccaagaccctgtctgaaaaacaaaatccaaaacttctactatttgaaagacacagttaaggaaatgaaaagacaaaccatagagtggaagaaaatattttcaaaacacatatctgataaataacttgtattaaggatatatgaagatctctcaaaacttaacaataagaaaacaagcaacccaatttaaaaatgggaaaatatttgaacagatgcttcatcaaaggaggtatatgactggccaatagttatgtgaaaaaatgcccaacatgcttagttatcagggaaatgcaaattaaaaccataagatcagaccaatgcatacaaaatggagtggcttaaaaaaaccctaacagtaccaactgccttgagggttctcagtaccaactaagaactcttgtacactgctggtaggaatacaagatgggatcaccactttgtcaaactctgtggaagcttcttataaagtcaaacaaatatttaccacatgacttaccaaacatactgctaggtacttacccaagagaagtgaaaaattatgtttgcacacaagcctatccaccaatgtttacagtagctttatttattatcaccgaaacctgtaaacaaccccaaagcccttgaacaaactctggtatatttatgtaatagaatgcttatcaataaaaaacaatgaactaattatatatatatatatatatatatatatatatatatatatatatatgatggataaatctcaaatgcattctgctacgtgaaagaagccagactcaacagctgcgtatctgaattattccatctgtgtgaattctggaaaagggaaaactattgggataggaaataaaggagagcttgccaagggctggagagtaagggaaaggctgactacaaagaggctcagatggatttggggagtgaaagtgtcctatatttttactgtgatggtaacatggttgcgtttgtcaaaactcatagaattgtacactaaaaagagtaaattttatcatacacttatatcttaatatacttttcagaaagcaaagtatgtaattatacagatcaacaggaagaacaaataaaaccatacaatactcacacctgcaacataactagaagacacagaacactataatcttccaattacccaagagaataaaaataagcaaccattaccagtggagctctttctgaagtttctgccccaaaccttgtcaccgagtaaggcagagcctggataaaactgcatgggaggtgcatggatcacctgaggtcaggagttggagactagcctcgacaacatggagaaaccccgtctctgctaaaaatacaaaaaatagtcaggcgtcgtagcgcccgcctataatcccagctactagggtggctgaggcaggaggattgcttgaaccccaggggctgaggtttcagtgagctgagatggcgtcactgcactccagtctgggcgacagagcgagactctgtttcaaaaaacaaaacaaaacaaaacaaaaaaacaacaacaaagagaaaaactgcataggagagagaacaggggaatagagtgctcaagactgagctaaaaccatccccagaaagactggaaacagcctagttgtccttcaatagctggatagttaaaggttagaccagcatggtacatccatgccccaaaatgctgctcagtagtcaaaaggaaggaactgttgtctcagaatgcggatggatctccaggtcattctgctgagtgaaaacagacaatctcagaaagctatctttgtgtgattccattgatgtaacactcttgaaacaaaattttagaaatggagagcacattagtggttgccaggggttaagcagatgtggctgtaaaagcgctgcgggagggatcccgcggtgacggagcactctgtatcctgactgtatccatgtcaacaccctggttgtgatgtggtcatacagtgttgcaagatgttacactggggaaaactgggtacagggtacagtgggcctctctgtatcattgcttacaactgcttgtgaatcatgactctacagttaaaaagctcggtgaaaaaaaaaaccctcatttacaatcgcatcaaaaaatgtgaaatacttggagataaatctgacaaatatgtgtaggacttgtagactgaaaactacaaaacattggtgagaatgaaaggcttaaatcacagtacgctaacaatagatggatttgatgaatgtaagtgaagggaaatagtgttgatcacagacctgaaatttttctttttcctttttttgagacagtcttgttctgtcacccagtgtgtagtgcaatggtgtgatcacagctcactgcaacctctgctccccgggttcaacaaattttcctgcctcagcctcctgagtagctgggattacaggcgcccaccaccacgcccagataatttttgtatttttagtagagacgggagtatcaccatgttggccaggctggtctggagctcctgacttcaaatgattcgcccacctcggtctcccaaagtgctgggattataggcatgagccaccatgtccggcctgaaatttttcaaaataaaatgctggtaagagggaaaaaacaaaaaaagcataggaagaagattttaggaatgcatagttagttctgctataacacaatatatgtgttcctaaaaaaccagtgctctatgcaaaaatcacataataaaaaccactgggcttatgggaaaagtggggttaaccgcacaacactccaaaattttgtcagtagcccataagaaacaaaaagataggaacttaataaaaatagtcattgagttttgcacgtttgatggttaagaaaagcatgtatattgcaataaatatgacacttgatcttgaaaaagccctggagtttgtgtgtggacgtgtgtgttaccagacatggagctgtaacaccagatgtggatggatgcagctcataacacacgaggtggatgcggagctgtgggcatttgaggcatccatctgggtgtattttggctcggttcagttgggtacaactttctgtgctcacctagagtttcttgtagaccacattgcacataagcaagtgtgaaattcacatcatgctcaaattgttccctaatactgtaactcaatctcatgggaacaaatttctgttttcaaaacaagtattaacagaatggactgtgcttgttaaagtcacaggtggcaatcatcaacaacttgttagacagtttgctctttaaatgcatagatttctaaatctaaaaattaggaaaaaaaaaaaaatgaaacctcatgcccaggtgtgaccatttcttgattgcatcctcacaggattttgggttgaaagaaaacaaagtccctgattctgccacagcccacccaagcatgtcctcagaggtggcattgaattgtcccattgcactgtcccctgttgtctgagactgcactgtgggccaaacacccatggcaggccccacggaggggactctgataccatgtcatctccactcagtcatctaattagatgttggtcaggtacccactggaggccggacagcacataaaggtggggagggggtttgtggggggcttctgatggagacgagtagaccaggtgagtactaaatgactcaatctagatgagaggaagaaagggtcataggtattcattcggaacccagaaggcctcagacaagtgctgtgcacctcgccctggacaacccagcagggtcaccctgcagctgcagggcaggctctgagcttgggcgggcacagactctgagcctgggcagcctgagggtacagagggtgccagaattaggcccctttcgttgcctttgggagatcaatgcctgcaagggccccgatgcagccaggtggaaggggctcagcgtggggacagtctctcccatgtgctggctggcctggggacagctttgcctctgcggattagtgtgagaggtcaggacccccatgaagccatgccccccccccaccaggacatgagaaggtaccagctcctggagttttgtgtcccaggcctggtcgggacacttgggctgccagggggcctggtcctgggccactctcaggccaactccaggctgaggaccgggagctggaggaaagggctggtggtctctgaaccactagcttccctgtggttcctgccctggtggctgaggttagtgcgactcccctcaatccagcccggtccagaacgttctgagttggggatgggagcttcttcccaccagagaaagcattgcaaacctttttgtggtgaaaacatccaaatggacagaaaactagagagggtggatccatgaccctatcgcccatcacccagtgggcccagttcttgactctgttttgccaagaagggggatcaagtccccagcttttgaagatatgccagactgggtttgaaaacttccgcttctctcagacagagcactttccaacccttggccctagtgggtccatctatgatgcggagacaggaatcccaaactcagagggggctgcgaagatctaatgaaggaacctttgtgaggggctccctggagaggcagacacactgagggtgaggaattcaggttggacctgtctccggccacagccagtccagggcttagcccatccttgctgtgtgccgcagccccttgctctcagctttgactctcacaagcctcaggtcctctgtaggcactatagagaggcgatagtcaggccccactccatcctcctcctccctgctgcccaccgaggttccttcaccatctggacatagccctgagcccgggctcagctccagtcccaaggcttgggcttgcagggcatcagctccagcgacctgccttctccccccatcgagggctgtgtgacgtgtgtgtgcatgtgtatgatgtatgtggttgtgtgtgtgtggtatgtgtgatgtgtgtggtcggcagtcagctgggtaggcctagacctgcccagtgaccccagggacaaaggagcagtcctttcggatcctcccagcgcagggatcctctgatggacaaggagacgctgcagtcagaggcactgtgttttcaggacagactgaggcaaagcattttggcaaatggccttggagccctgaacaccctgagaccttgtcaccgccaagcccccggaccaggtatacacagcaattctaaatttgctaatagcctcattaaaaagcaaaaggaaacaggtgaaattaattttcataatatattttacttaacccaatatatctaaaatgttaccatttcaaagtttaatttgtatatgactgagatattttgcatttctcttcatgctccgtcttcgaggtctggcatgcacccggcactcacagcacgtctcagtgggaccagcccggcttccaaggctcagcagccactggagacagcacaggtctagtgcagttgctctcaactctgctgtgcattacaatcacctgagagctttgaaaaagtgccagtttccgggctgcctgggaaccccctcatagttacatgggaatctcagggaggggtggggcagacaggggtcactgatcctggggtgggaggtgtcacagccccacggaagggcttcccatcagagggaacagcgtgtgcaaaggcaggggagtggggaagagcaatgtttagggggaactgtgagtggtggtgtgtgtgtgcagttgtgtgtgtgattgtgatgtgtgtgcacatgtgtgtgttgtatgtggtatgtattatgtgtgtggtgtatatggttgtatgtgtgtggtgtggatgtgtttggtatgtgtgatgtgtgcagttgtgatgctgtgtgttcatgtggtgtgtgtgtgtgtggtattctgtggtgtgtgtggtgtgtgtagtgtgtggtgtgtgtagtgtgtgtgtgtggtgcagtgtgtgtggtgcattgtgtgatgtgcatgtgtggtgtgtgaggggggtatattctgtggtgtgtgtgtggtgtatatggtgtgtgtggcgtgtgtagtgtgtgtgtggtccagtgtgtggtgcagtgtttggcatgtgtgtggtgtgtgtgtggtgtattctgtggtgtgtgatgtgtgtggtgaaatgggtggtgtgtgtgtgtggtgtgtggcgtctgtgtgtgatgtgtgttctgtgtgtgtgtttgagtggagagatccttcaacctgaaggatcctgagcctttctcttcaggacaggtgaggacaccttagctggtggctgtgtttcctgcgctggggagtcagccgagcggagccccaccatggctaggtgttacatatgttcagtatcacctctgacttcaaaaaagcgagcacccccatttccaggaatcgcctgggaaccgtttcaaaggagtcgtgccagccaggacagagagctgggaagcgggaccacaggagcaactctgaacagtcattggatgcgctctccaaccagctgctctgctcacctcaaagcacacaccaaagagagggagaggctctgagcccatgcgggtgaatcagggtgagccacgcaaatctgctggcccctggcagtcatggcagatgctgccaggaggcctccctcattactcggagtaggcttgaagtcatgctttccagtgtgaggtgcgcgagccaagcaaaggaggaggcctggtcaggaggggggagttccctgtgacaatggaatgaaaaggctgctgcagggcccagctggccctgggcacggtgtggggaggggaatccgcaaaccaggcagagccctccagcccagggcgttagttgttgacccatctttcctccccaccaccagactgggagtcctcatcctttgcgctttgcagtttaggaagcaatctctgaagagcacaaacctatttaacaatgataaaacttcggctttaaagggctgatgtggcacactggcactagagccaggacacatgagggagatctctcttctcctgctcagcagctggcctcccttctgagggcccacctcggactgactggaggacaccacttggaatggcaaagatgggggcaatgcaaaggccacaaggatggcttcatagacaggatgtggacttggcattgggcagacctggatttaaattccagctctgcctcagtctgttttccattaaatgaagatacttgtgcaagggttctgtgagaattccagtggctgaagtgtgaagcattccccactcagggttgcacagctgggactgggtgaacactgttagtaccctcaccctgtgtgctgcagctgcatcagggccagctgcccttctcacaagcacctatgcacagatagcccccatttcaccccaaaggacaactattcagagaattaccatccatcaagccagggcactccaatcagaggaaggtgtcacttcctggtaggacaactagaagggcaggagctattcactgagcataagaggaaggcatggtacaggtggggcatttgtggagagcaagacagggagcagagaagtttctggcaacatgctgctcccagaggaatagggctgccacacctggtaccaggaaactggggaatggccacagctcagctctgccactcaagaaccccacttgccacctgcataggaaaagacaacattgtggccacagaagggtgaggggccccacagaactggggatgccaggacacttggtccatgggaagctgccttttgctctggcctgtgcctggaagcaaaaccatcatccataactccatctaaggattcttagagcagatactagctggaccacaaggggcagcccaaacctttctgttccatcccatggcctggcccttgctggcccacagctcacagaatctgctggggctccccagctcaggcagtacaatactctgttgaccatacgctgacaggtcaggcactgctcttcctagttggacctgatactagtcatgattcactcacctatgcagaagcctgtgcatgcaacaaggcttagcccttctcccatggagatgaaccttttgttcctccctcctgctttcaccacccccaccctacccaaagaagaggaagaaaacagagtagctttggcaaccttttctacccctctcccaggcaagaaaagcagaagaacaacctgaagaaccaggcttctctcctatatcctccatctcgccttcagcctgcatcccttcttactaccctctctccattataatttgctctctgtacattttaaatcaatcaaattagcaaaataaatcatgaaaaccctatacatttataaacatagtaatatgtgatgctcataagatgcaaggagatgggtactttcatagtgttgatagtaggaatataaactgaaaatgctttttttggtaaggcaatttagccatttatatcaaaacattaaaaatgttcatccctcagacccaggcattcagtctcagcaatgtatcctagagaaatctaaaatacaaaagtcacaaagctcaatgcaagaaaatgttatcatcttgctaattacaaaagtggaaaattgaaaacaatttcaatttacaatatatggaactggttaagtaaatatagcaatgggatacaacattggacaggctctaaaacagtgtttaaccagaattattaaacattcattttgtagtatgaagtgactatagcaatgtaatacaacattgggtagactctaacatggtgtttattcagaatttgttttgttttgttttgagacagggtctcactctgttgcccaggctagagtgccatggcatgatcatggctcactgcagccttgacttccccaggctcaggcaatcctcctgcctcagtcttctgagtagctgggactgcaggcatgcaccaccaatcctgtctgttttttttttttttttttttctatttatttgtagagatgggatttcaccatgtttctcaggctggtcttgaactcctgagttcaagtgacccgcctgctttggcctcccaaagtgctgacattactggcatgagccactgtgcctggcctattcaaaattctaaatgtttactttgtagtgtaaaatacatgtggtaaatttattttaatatggatcctataaaatttcatatacagtatcaatctcaaagacatttaaaggtttttgtttcaaataataggaaattgaatgaaaaggaataaagcaaaatgttgactggttgtcatcaagtaataactgtgtattatttattttcattcatatattcctaaattttctaaaaggtttatactgttttgaattttttttaatctttaaggaaatcaacttttatagcttagagtgggtaaattttaattaatatgttccttttgtcaggaatatttgcaatctaaacacactttaaactttggcttttctcttgtaccaccctgttgccatttaccaaactatagtattcacagcctatatgtttattattgcttcagtcctcattgattgtatcctatggactatgcacctatttaatcctcatacagagtatactctgtaaagtatgctgtctgacactgaaagtcagaaagtttgagttgcttgctcaggacaccaaaggtcatcagcagaggctgcttgatactgtcagtacttttcagatagtcactctatcagggctttagtccacagtgctcctgtggatgctaaccctacctgggattgctctccttttccttgagccctcctgtcttaggctgttttgtgttgctataacagaataccataccctgggtaatttataaagagaagaaatttatttggctcacaattatggaggctgtgaagtccaagagcatggcaccagcatctctgctttcatgttgcatcatcccatgatagaaggtggaagggcaagcaagcacatgaaacagagaagggagggggccgaacttgatccttttatcagaaacccactcctacaataacagcattaatccattcatgcaggcagagccctcatgagctaatcacccctcaaagcaccctcctcttaatatcatcgcaatggcaattaaattacaacatgagttttggaggcaatgctcaagccatagcacttctcaagaagggcaccagcagaatatgcttgtgatcgctctgaatctccatcaggtcatagcatggaatgaaggtatctggtttactcaagcatccctcccacggcctgaggtcccaagattggattttctgttcccatcattggaaagcagaggaatccttgtggaagtgcatctgccttcacaggaccacaccaggagcaggaattgtaaaatccacctctgctctcccaagagagaaggagagggagggaaggagcacatttggcaactgagagcatgcaacagaaaccattccttggagatcctatggggcaagcaatggaagggacactaatttccatctggaaaagatatggccagagctctgacttcaaactctggaaggaaggtgggggctgacccctattgaggatcttctgggcaccagatgctggactgggtatttaattctagtcaatttattgagggaatgagactccaaaaggtgaaataccttacccacagtcatgcagctggtaggtgacagagatggagctgaacccagactcttcctcttatccagtcacataccgagaccctgcattgccgttggaagctatttgcctttcttctcagcactctgggtgtcgtttgcgtgctctctctctctctttctctcagtaacttcagactagagaatggggtaccaaggtcactgataaggaagcccagggcctgggggtaaattttagtgagtcggcagtcctcaatactcagacagatcatcttcttcatgatgatgaagcaccatcaggagcttaccatttggagagataggatggcttaaccctgaatctgtgcctgactggggtctcataccctggggattttatagtgtaagctcaggaaagggattctgatgcctgagcagagagaatgccctaattaagaatgacggccagtttggacaatctccctgaatcccaccgacaaaagaaacaatggcttcccaatgacatgggtctcaagatggacttgggcagagcaggaacatgcaggggggttggtggtcttccaggaggcagggataaagcccccagcaggaggaagggccccccaaggctctccttcctatctctatctctggtcagtatgagactgagtcattcacttagctaaggaccagacaattaaagcacaggaacagatccaagcagatgtataaatctattatatggtgaagtcatactataggtcagtgaggaaaggatgagttccttaaaaaatatattgacacatctggttatccatttttaaagaaaataaagttaaattcctatcacataccatgtacaaaatttccagatagattgaatagctaaatgtaaataaataaataaatacacacacacacacacacacacacacacacacacacacatatatattatattataagaaaatgttgtgtaaccttacaatgaggatttctacttaaataaaataggaaacctaggcgaggtgtaatggctcatgcttgttatcccagcatcacttgagctcacaagtttgagaccagtctaggcaacgtggcaaaactccatctcaaaaaaaaaaattagccaggcatggtggtgtgtgcctgtagtatcagctattcgggagactgaagtgggaggatggcttgagcccaggaagtggcggttgcagtgagccaagatcccaccactgcattccagcctgggcaatagagccagaccttgtctcgaaaaacaaacaaacaaaacaaaacaaaacaaaacaaaaaacaggaactctagagcccataaagagaaaaactaacttgataaatttggttacataaactttttaaactcctgattttgtaagccattaaacagttttttactagactagaagaaaataattgcaatacttaaaatagacaaaaggtttatatccctgatatgaaaagtttatgaaattaataataaaaagacgactataaaacagataaaggacacaaagggcaattaacagaagagattatacaaatgaacaatagcatgttacaagacaacagtgttgggataatgcaaattaaaattcatcagtttagcaaatgtttaaaatgttggtaccagtagtctaattttgatgacactataaattgctacaatgattttgagaattaacctgacagttactgctgacattttaatctggatgcccttggatgccacttctggaaaaggccagggatcataatcaaaacattaagttactcttacatcacaagcatgccctgatcagaacagacactgaccacaataaccaacaagactgtagcatacttaaaaatagatgtatacgagtatgctccttgtacaattgtttatgttagcaaacaaacaagcaaacctggaaacaatccaaagtttcatctatagggagaagaataactaaattatgaaggatcatcaatctggaaccactgcagctctttaaaaaagaaaaagaaggtaaaactactattattgccctggcaggatatccactatagctgtaaaaaaaaaaaaaaaaaaaaaaaagtttagaaaataaaaataaacaaaggaagtaattcaattgtagctcttcaaactgagatggtaataacagcaattacttaagtacagtgtaattatgtcttcctgggggttggttacatcttggcaaagtttatcacagcaagaattggttttggcttctggggttggagccttagattggagatagaaaaaaaacctcaaaggaagcattcctgtccagaaggtaaagtgattcccacccccctcttccctgctacaaaaggtcatggctttggggggcactgaggtctggcatcaacccttaagtttatttttcccataaggaaaagcacaggagtctcatgctagcactttagagaaccaagcatgtggatctacagttccagggaagtccctgactcggggacacccttctcctgaaatccccacactcagtcagggccctgtcatgtgttcccatggcccccagttctcttcttggtggcacataccacacgggtcatttatgttaggatatgtacctctttttccctccatgagactctcagggggtcaccatcatccccagcacctagacagtgcccagagctttgcatatacagggtaaatatttaccacgaataaatgaaattagtaaggggctacaagaacccaagatgattgaagagatataccaagaaatgatcaaatgacagccagagtgtcagtcactcagctggttccaaatgcctaataaaaattaactccctctgtccttaccacagccctatgaggtggccacacttattgtgctcactttatgatggggaaacaggagcatagaagttgggcaactttccaaagtcacaccgtgagcgattccacaacaaggggttgaacccaggctgtctgggtccagaggtcttgttcttaaccacagtgggctgctgcctcttctccctaagctagtgcatcctggaggtcctcagaatgacttgaactggccagagggtaaacgtctgctgaaggaatgaatgggcaatgaatttctaggaacctggggccctggggtctgggaaggccgttgcctccccaagggaatgacacagggccagtctgctctccttctgtgtgggcccctggacactggtctggcattgtccagacaccaaagcacatccgcatagcatgcatcaaacaaatggtgacctgctaatgaggaaatggctaaaacaggaagccatgaccagagtacatgcttcatgcctccagccccgcattgggtaatggaagggcaattacttctccacctcttcacctatacagggcagacttgcctagaagttcagagtccttcctgccaatttggcatcctttcttccagagtgttcccaggctaggtggggatgggaaaagccacaaggagcacagcaggatgatagagatgtggccaatgggcaatgctggcactgccaccctggccagaagagctcactgtgggacactttctcattgtttactagggaagaggaggttggtttggaattcattttgatttgttgttgtaaattctctttgctgtcccaatttaaacaaaaaagaaaatggagaaggggagtttttaatcaaatggattttcacttgggttttatcatgaacctggaactgctttgaaagctgaagccagctgggcttctgggtcgggtggggacttggagagcttttctgtctagctggaggattgtaaatgcaccaatcagtgctctgtgtctagctagaggattgtaaatgcatcaatcagcattctgtaaaaatggaccaattggcactctgtaaaatggaccaatcagcagcactctgtaaaacggaccaatcagcaggacatgggcggggccaaacaagggaataaaagctggccacctgctccagcagtggcaaccagtccctttctgcactgtgggtgttttgttcttttgctcttcataatgaatcttgctgctgctcagtgtttgggtccgcgccacgtttaagagctgtaacactcaaggggagggtctgcatcttcactcctgaagtcagggagaccatgaacgcacctgaaggagcaaattccagacgcccacctttaagagctgtaacactcactgtgaggtccacagcttcattcttgaagtcaccaagaccgagaacccaccagaaggaataaattcctgacacagcttgattttgtctttggtgagaattaagaagggtcacatccactgatgaccagttgggggatagatttacactggctatgcccagtggtactcaaagagccacaattactctcactgtggagcttccttcagtgacaccagagaccaggaagggagctacctaggagacctcagcctgtggaaatcaaactgtggtgtgagccctcctgttagcgagcagtggtgctggctgccttctcacactgccacttggcaaccagaatacagggacttcaccgtgagtttgagctaaaacttgcctgctagtgaatcttagcataggtaattttgggttaggagaattttggtttctctgatgacttggttgacatctttgagattcagcaagccccaattcagattagacttaaaacttatcagtgcaagtcagacagcagtgattactctgcttgttgagacctagggacatccgtttgaattcagtccgcaccccatggacgagcccagctcaatgccaggaagtttatgaattcctggggccttctagtctcatggttacatctgctgccaaaaaccagatcctatgaagttagttcagtttagtgatcttctcaccaagctgcaggggccatcctgttttgtaccatggtgatgaggcacagagcacaccctctttttaccttcaaagaaagaagccagacattgatacaggttactgtgtatgcagcagactatcctgaaggtttagggagacagagtattgatatctcagatctgcaaacaacagaacagccccttggggatcactatgatccaggcagaaggcagaatttgttttttaatcaaatcaccaattaatgactgaaaacagtatctcctggaacaagaaattattattcctctaggcttgaaacaatatgaaacagaggaaagttatttgcaaaaattggctgaatgtgcaaattatgcttccacgtgaatagcaaagtaattaaaaccattttcagaaagtgaactactttcttaaaacagcatgccgaaagtggtccagagttcaagattttgaaaacaaaaacaaagttggtacttgaattcacagattgaagctaactagaagtcaaagaaaagacacactggattatgagaaggagcagggatcacagccaggtgcagaacaaagtctgagcgtgcctgaccttccctggaggttccgcccatgtcacctgcccactgggtgtttcctgttttgaccatgcattccttagaccttctgttgttaaaattttttctccttgagaactttaactggccagaaattagaatccaattttgaaaataccaagctactttcattatgacactgcagttaagcaaatattacccaaatttggacagccttgtccaaatttgttttatattgttttatatttagcaatataaagcaaagtgtcccatttaaaaattggtaaaaccttataatcaatatgcattaaaaatttttagtatcacatcattattaatggcaaaaatttccatttataaataacagaacttttgttgattgtatttattcttccatcctgggatttggggttttttcaattttgttttttaagtttgtttttaattttttttttttaattcagaaagagaccttgttgccaccctctgcatactcagaaaggaaccccagtccgtgcagaaaggggccacggacagtggctgtccacccaggatgggcccaagaaaggagtcgatgtcctgaaacagtccctgcccctttcctgagtgttgggggatggtgggaacgacgaccatgtagctcctaacaaagggcgtctgcctctgggggtgtcctggggcgtggcttactgagggcttactgaattttaaaaattcagatttcagccaggcacggtagctcacacctgtaatcccagcactttgggaggccaaggtgggcggatcacctgaggtcaggagtttgaaaccagcctggtcaacatagtgaaaccccatctctactaaaaatacaaaaaaattagttgggtgtggtggcatataattgctgtaatcccagctactcgagaggctgaggcaggagaatcgcttgaacctgggaggcagaggttgcagtgagccgagattgcatcattgcagttcagctgggcgacaagagcaagactctgtctcaaaaaaaaaaaaaaaaaaaaaaaaaattcagatgtccagcttttcatgaaaaaatccaaagttctggtcacacgctggacaacaatagccataggtgagcacctgctgccctgggaacaggcacgtgccctccaggtggtgaatgacccacttctctcaccagcttcaattgtgtccatctaggacatttggaactcttccaggctgctgcactcaccaatggcaccttcctggcctcatgggcatttgagtttgtactcctggccaggacctaatgctgcagaccagataacttcctgggttcttgccctaaaggaggagctgaagccataagcgcagacctctaatgtggctcagagacactgtggagagagggcagtccaggcccagggtcttgacggtcccgcccctggacttattaggccccctctgcatagctcatagtggcagtgataccagacgtcacctaaaccttcccactcctgcggcacccactaccattcagcctcagggccatcctaaccttaactccaggctcctctctcacatgggactattccagctctgactttagctcccatgaagaactggctcccgagtcctggctccccatccaggacccaggttccagtcctctcaatgggctctccctgatagaggtcaccttgggtctggtggcctaccccatttcttacaacatacaccccacaccagccttgggccagccacctcctttgtgccccagaatggctgtcagggaagaccctgcctgtgtgccccaacctgtgggcaaggcaaggcctagggctctgcccaccaggaataacagacccagctagggaaaggcaggctttgagatgcacgtgtgatgttgaccctccccccgggtcaccccaatacccgtctgcctgattctctgttgccccacagggtcccagagagtgctgagctgcacatttgacaggctatgtgcccatgggtccaatgtgtccatggatgacctgaattccaaggccatcaggaaaagcctattgtgttgggcccccaggaagccaagccaggctggctaccctgggatcttcagaggagagcagcctagcttgtacagatcccctccatgggccaggccctagaaatttcacacaaaaaaattatccttttttacagcaactcatgagagagaccatgaggataccattttacagatgagaaaactgagagtgaaggaggtgatgcaaccaatgagtgacagaacatggacatgaaacatgtcttggcaactccagtacccaagatttctccatgtcagctgtcagcctgcctggctcacaaaaccttcatccccagtgtagaaaggactgatagacaagttaggggcttctctctcacagggcccttgtgtgtgcccacccttcacacacatacacccattcacacatacatacatacatctgcacacacaaacacctatggggtccacacacatgcacacaaatacacgcacaaacaccctgcatatccacacatacacacaggcatattcacacatatatacgtgcacctgcatacaaacacacacatagacacaaacacccataaatatccacacacacacaaacatgcacatacacacaaatactcatacacaaacaccctacatgttcacacatacaaactcctgcactcacacaaacaccttccatatccacacatccatacatatatattcacacacacacacacacgcatgctcacacacacgagcagagcactggaccaggagcaggagctgggactctcgtcccagatctcccatcacacttctcaagccttggcttcctcatctgtgagatggggttgtgccgcctgcttcccagagtgttgcacaagcaaacatgcatgacagcccaggaagtgagaagggtgtataggaggaaagggtcctgatttttggcagaagttgcccagggagtagtgagtgctccacacctttgtatgtgctgtaccttctctctggagctcttttctcttcttctctggctggtgaactcatcctcaccttccagctccaacaaccacactttgtgttcctgatgtctccctgtagtggaattcctccaccatcctcagtgtccccagctcctgtgtgagacaggacttcctacactggagtgggacacgtgaatgaggctgcatggctcttcggagccggatgagtcccgacttctcctgccacaacccaagtcccttcacagacccacagcacagtctctcagaggtatcttttaaggccagaccctggccttccctttgacagcactgatgcaaagctcctgatgtgactaggagtttaagaaccccctaagtgcccctagctgcctggtatagacctgccagcctctgcccatcctgcttcatctgctctgaccttttgctctctggtggagtccttgccatgatggcctgggcccagtctggtctggcctagggaggcgcttttctgcccaggcatcagggcctgtcctcacgcagagttcagaacacacagaggcaccccatcactctcgaggtaggcctcacacctcgcaagtcagcctcaaaaaagcaagtatgaggcaggatcccctttctggctttgggtaggggctgcagttcctcttgccatgtggaagcttcttaaatattgtactacaatatttaaaaatattccctttgttctacataccattaatagatcaactcttctacagctctgcaatcacttctgacttggcaaagctgagcctgagctcagggaagggctctggcttcagccttgtgaagcagaaagatcgtggactctcgcacaggacccctgtttacatttctctcaagcacagcctcaccttctcagtcctgctccaaaaacaccacacaacttccagttctgagaatgcaccctgttctctcagccctgggctttccacatgctaaccccttctcagaacctcccttccttcacttcgatacctaactgatttctattctccttcaaaaccccattctaacatcacctcttctgggaagcttctctgacttctctgaggccctcccaggctatcatttccttcctgataatggctccttatagcactggccacttatatggaagtggtgcatttgagtctctcccactgcaccatgggttttcaatggaagagtgtgtgtatcattcctctttgtaatcccagctctgtcatcacaagatggaattcaagcatgtacctggtagttgatcaagctctatattcatagagcccaaacccaaacctaaaccaagaagaaagaagaaaataatagaggctagtctagaaataacatagaccaggctaattccttaataataaagacaatagagaaaatacttccccaacccttgctaatgccaatgggaaaaaaatagagaaatctttaaaaaccaaaattggttatttgaaaagattaacaaaattggcaaatctttaactatactgaccagaaaaaagaaagattaaaatcagaaatgaaaaagaagatattacctctaaccttcaaaaataaaaaattataagtgaatgctatgaacaattatatgtcaataaattaaatgacttagatgaactggagaaattcctagaaaaacacagaaaccaaacctgactaaagaagaaatagaaagtctaaagaaacctttaacaactaaagagatgaaattagtaatccaacaactaactgcaaaaagaaagccaagccccaatggcttcattggtgaaattaaacatttaaagaataatttgcgttttaaaaatatttgcatttaaaggagcttttaaagaaaaattattatcaattcttcacaaacttgcaaaaagttaggcataaacacttcccaactcattctatggggccattactattctgatactgaaattagacaaagacatcacaaaaaaagaacactactaatacctcttatgaatatggatacaataataacaaaatactagcaaactaaattcagcaacatataaaaaggattatacacaatgatcaagtgcagtttgtcccaggaatgcagggttggtttaacatccaaaaaatcatcaacgtaataccatattattaattgttctattaatactatattaatagaataaaagatcaaaacctcataatcatctcaatagatacagaaaaaaatgacaaaatacaaaactccttcatagtaaaaacactcagaaagaataaaagagaatttcctcaacctaataaagcgtatatactaaaaaagcagcaacaacaaaaaaaacatagataacatcacatttaatgggaaagacaacatgctttccttctaagatcacaaaagaaacaaggatgtctactcaccacttccattcaacatcatactgaaggttccaactattgcaattatataagggaaaaaaaggcacccagataggaaagaaagatgtaaaatggtctcaattggcagatgacacgatttttctatgtagaaaatcctaagcaattcacaaaaaaattaaaatatgtaaatgaattcagcaagattttagcacatgagatcagtttgcaaaaatcaattctgtttctatacactgtcaatgaacaagacaaaaatgaaattagaaaaataattccatttacaataacatcaaaaaatacttaggaataaagataacaaaagaaatccaaatggtatattccgaaaaatataaaacattgttgaaagaggtcttaaaagatcaaaataaatgaaaatacatatcatgtttttggaccagaagacttattgttaaagatagaaatatcccagagttaatctataagttcaatgcaatctctatcaaaatcccagatgacttctttgcagaaattgacaaggcaatcctcaaatttatatggaaaatcaaggaatgcagaatagccaaaataatcttgaaaaaagaaaaacgaagctggagtactcacgttttccacattcaaaacttactagaaagctacagtaatctaaacagtgtgatactagcataagaacagatcaataaaatagaactgagagtccagaaataaatccatgatctatctacatacatctattgtcaattaactttttttttgagatggaggcttgctctatggcccaggctggagtgcagtggtgctatctcagctcactgcaacctccacctccctggctcaagcaattctcttgcctcagcctcctaagtagctggaattacagacacacaccaccacacctggctaatttttgtatttttagtagatacggggttttgccatgttgcccagctggtctcaaactcctgagctaaaagtgatccgcctgccttggcctcccaaaatgctgggattacatgcatgtgagccaccaggcccaactgtattgtcaattaatttttaacaagagtgccaagaccattcaatgggggaaataataatcaaataatctcttcaacaaatggtgctggaacaactggatatccacatgcaaaagaatgaagttggactcccatcttacaccatatagaaaaattaacttaaagcgggtcaacaacctacatataagagctaaagccataaaactcttagaagaaaacataggagtatatcttcataattttagctttagcaatagagtcttagatatgataccagaagcatgaacaacaaaagaagaactagataaattagacttcataaaaatagtaaactttcgaacatcaaagaaaattaccaacaaagtaaaatcatacatctaataaaggtctggtatccaaagcatttaaagaactcttacagctcatcagcaaaaacacacaactcaattttaaaatgggcaaagacttgaatagacatttctccaaagaaaatatacaaatgccaacaagcacatgaaaagacactcaatatttttattaattagggaaatgcaaatcaaaattgcaatgaggtaccaattcacacccactgtatatatatgtaataggtggatggatatatataatatttatatataattatttataatatgtatatataataatgttattatatgataaattatataatacatatataatttattgatttgagacaggctcttgccatgttatccaggctggagtgcagtgacaccatcacagctcacagtggcctgaacctcccaggatcaagtgatcctccacctcagcttcctgagcagctaagaggtactacaggcaggcataaccatgccctactaatttcttaatttttttgtagagacaggatctcactatgttgcccaggctggtctcaaattcctggcctcaagctatcctcccaaagtgctggcattagaggcatgagccactgcacctgacttaggatggatatatttttttcaatggaaaataacaagggctaacaagaatgtagaaaaattggaaccctcagacattgttggtgagaatgtaaaatggcacaactgctgagaaaagtttggtgatttctcaaaaacttaaatatagaattatggtatgatcaagcaattccactcctaggtatatacccagaagaactgacactgactactcaaacaagtacatgtatctttatagcagcactatgaacaatagccaaaaggtggaaacaacccaaatttccataacaaatgaatggataaacaaattgtgatatacaatggaataatagccataaaaaggaatgatgtactgatacatgctggaacatggatgagctaccaatttacaggaaacacagaggacaggggacatgttgaatagcaccatgagagtgcagtcagcaaaatccagactattggaaactctacagatcaaatgacctgggtcttgggagggggtaggaaaacctgtgtattaaccaacttttaaaagatgtatttttataaaataagtgagatttaattatagggtgtagggatatacatgtgggtaataattagactatgaagcaaaggaaaggagtgtctactgtaagtcaaggtagtggtgactttggagaagagagtgaggaggtgcctctggacaaagttctgtttcttagtctaggtggtggttacaaagctttactcttgtaaaaatccattaagccatgcatttgttttatgtggcttcttatagctttgtttatttgcaaataataacctggttcagagattctgattcacagggtgtggggcagagttcaggaatgcttttaaattttcccgtgttgtgtgcgcacacacacacacgcatacatatatatctgtcttccacaccaggctggtgcctgtttgaggaaggtctgtggcttgcctcaatttggacttcccaacctccagaactataagaaataaatttctgttctttatgaattacccagcctcaggtattcttttatagcaacacaaaacaaaccaagacagcttctatctctctcctactgacctatgagcagggcatgctttgtttctgtctttgcattcagcacctagcacacagtaagtgctctgtaaatgctgatgaggctgggctgatacacaggtggactgacagtgggcataccagacaagatccagtggcccctgaagcagtcaactcacccacagcaatgctggagggctatgaacttcccaatctcactgaggaccacaggagcattccacctctactgggcagtaaaatccagaacgccggctgcagacattccacttagagtcatgccaacatcctctctgggccccactagcttaagacagagccacagacacaggcgtccagaattaagagtccatctcagccctgaggctgatttctcactacacactgaccctgagaaaaacttcagggactgcaaaaggcagccagaaacactgggagaagggagggaagaaagcgcctctgaaatagacagaaacactaatgcaccaccagtgcctctttcagacataagccagtccagctccccatgggcaggcccaggatcacacaggacactacaaaccaggtctctgcccaagaaccaggctgtaggggccaccagagcctcactggaacaggttaatgcagaatacagtcatgtacgtccaaacggagctacaggccttccccgttaaagacagtgccctccccggggtagaaaggaaaacaatactccttatcagcatgaccattgtatgttaagtcttgtgatgcatgtttgcaagttactccaagtaactatggatcttgtccccaactcaggccagccagctgacaggccctgaagtcagcagctacagttggctgattctgaacccagtgatgcctgctgtttgcagggaatgagatacttacttaattatctcaaatttaaacactcttatatgtttccttaatttaaaaaccatacacacacagaagtgaggacatctaaaaatgggatctgcgttactgatgtgtaagccagaaaaaaagaggagttctcaaatacactctgagctggacttcacagctacgccagttcctcaagtggttcgtggaggtgagcggcagatgcaggccagtcttagaatgtgaaaaatctgagagctataagacaattcaaaaacagacaataagtcaaatcccattgaattgtgttattttaaatataaagaaagaaatgtacaaacatttaacagaaaattagattccccctgtccccacaaatcaaatccaaaattacccatgtgaaaacttcacggcattatccactttccaccaaggcctccacgtgctcgttctctggccaggccttggtagtgtggactggtcaccatgtaaggacagccttctgtgagctgcagaccaagggaggtggcctggcagcctgttggaggccaggcaaggataaaatttactatcaatccttttttttttttttttgagatggagtcttgctctgttgcccaggctggagtgcagtggtgtgatctcggctcactgcaacctctgcctcctgggtcaagcaattctcctgcctcagcctcccaagtagctgggactacaggtgcatgccaccacacccagctaatttttgtgtatttttagtagagacagggtttcaccatgttggccaggatggtctcaatctcttgacctcgtgatctgcccaccttggcctcccaaagtgctgggattacaggcatgagccaccatgcccagccatcaatccctttttatgtataagaaataggctcagagaggccagatggcatggcccagtttgcacagtaaggtgattgcctgtcacggccaaatagccaccacgtccggataatccatggccactggtttctgtgaggtggtggagaggcggcctcagcctgagccctctggatcgtgggcaacgggtggtgtgaggaaactgtccagcagtgatctactgtccctgcactcccacactgcagggccaggggtgcatctgcatcccacgcggggaatgcctgggcatgaggcttcaagaagcacttagcaggaatgcaccgggtgctcagaggagccgctgtcctggcaggctttgctgtccacatttgcccctttgcacggagcctgctgtccctgaagtgctctgacctgtccacaggaaaccaggtcaggcacaaaataaccacccttgtctcaaagcaagggccctaatgcctccattccttcaatgccttttccttcagccaaggtcccctgcagtcttgtcctgggcactgaactgggtgctggggatgggctggattatgaggaaggaaggtctctgctctcaagaagaagtgggtcccccatcctagggcagaaggcactgccatcctgagtcagcttatcgcagctcagatttcactccctctgtgctgggccctgggaatggggagatgacactgccatggccctgccctcaggggctccccatcacgtggggaagccagacacaaaggtaaatttgggaggaagcccccaatgcctcataagctatcaaaaaccagagtccacagcaatgggaaaaacaaggcaaggaaggtaacctgcaaagaaacgagggctggggaggcaacacgcaaacagccagaggagactgtgaggaggccccccacagactcatcacctcaaagcggagccccaggaatgaacagtcagctctaggacgtgctaaatgccccaggagaggcacgaaccaggggaccactgacaccactcggccttcggaggtgagaggcggcttcccagaggagggcatattggctgagcaggatttcctcaggtagacacagggggaaaccaagcatcgcaactgaaggccaggtaacacagatctgccgaaagagacatcatgattttcaaacaagcaaacgaaagggattcattctattctgcaactgtcaggcatactcagaccaagagtaatctttcaaataaaccccagaaaatgaaatcacgtatgccatgttctagccccgcagtggaaagtggtttagcctctggtcccggagtcttgcctgtctcttctcccacccacctcccctgcctctctccccttcccagctgcccagaaggtgactaactgcatgtccacttttttttctgctgattcttcccatttctgatattaagtagcactttctctgcaagcaaagctacactgatataatacagatgaaactgggaaagtccaggctaaatttcaggatacgtatacagaaatgcgttgagatacagcacctcactcagcaaccatgccttatagatagtgctaagcttcagtcgcatcacagaactttctaccctgcatgagttctctgacctggctgtgagcttcttgtgggtggggtctcagtcattcccaagcagccagatgtgtctcagtgcctggcatacagaaggcatatgataaatgtttgctgaatgagtaattcacaagtaggtccattgttataaatgaatgttttggaaacacaagctgtcactgagttccacgtgtcgtgttctgctttcgaatgacctgccctgaatatatctcacatgcagtcttgcatatgcctgattcagacttttgctcacagctacggggaggtgttgagctctgcatgggccagcagatccaggcagaaagacttccatgtctgtacagcagcatttgttcattgctccaatggtttattttcccctggttttattaaaatagtgaaaaacactaaagtggaagggcttacactcaagagcaacacaattggaatgacagcatgggttttcaggggtgcccaaagaagtccttcccctctgttgtatgtccctaggtcttaagccactacactgaattcatgtgtgaaggaaaggaacaaaattcaagggtgtgtatgaaatgctagcaatatagccttgaatgctgtacctggatgtagagcaggaagcaaggcttgtaccgtctcttccttacctctctgagaagggaccccaccccaaattgatctgctctggctccgacacaccccctacatacgacccactctgtggaggcaatagggaagtcctgctctgtgtctgaaaatgtcaaagacagcttattcctgggaagccatcaaatacgccctgctctgctgtatatattattcaagtactcagtaaaccctttgtttctggagagcaaaggccactggcagcccaacctctgcccagacaaggaggggacaggcagggagctggcaagggcacacaggatcatggccagagggtgagctcagtgcccagaatctgtccccataggagcacagggtccccaggctttcaattctccagacttcgtttcccagcctataaaatgcgtacaaaactgacatcctctcgggatgttaagattcgatgatattacaaatgtgaaagcactttggaacccataaactgctgtatcaatactggttgatcgtgctcttattaagattattctattaataacccatctcaaattacatatctgtagacagtgcgtttgtgcatctattgggccagctgctctccaggccgggaagccagaaagatctcatggaggagctggtcctcctacttccttcccttgctaaggccaaacctgcccgaatgagcttcatctagagggcacctctcaggctcagcacctggagcagccctccatgtggacagccgggcctgtccagcccaaccagagggggccgtggattttgtccatggctgtttcccagactccatggcagtgatttagatgcccctgccccctggccgcacgctggaacatgtgcacctggtttctcccggcactgacctacttatccatcagttactcaactgtctactgacgtgtttattgagcatgtcccaaaggccaggtaccagaccacttgctgcatgtgacatgcagacacatatggaaccaggccagcccttgaacaatcacgacaagtgtcccaagtgctacaaaagagaaggaagggatgatgttgcagaaagtggggagggaggggcagtgctaacctgctctggggtctctctcgaaatttccttttgtttgtcctgctgacctttctatgcatgcttttactctgaagtcacaccttttcttaacctgtagaaaattctcggtcatgtcattctaccactccttctactgtatcttctctaccattctctccacattttctccttcagaacattggttgttaaaactcagccattttttaagttctcttccatagtttcatctccttctatctgtgagctgcttttagttttccattcgcaaattgtatctttgactagctcatctattgatttaattatcatagtttttatacctagatttctactcagttttttttcagagccaatctgttcttaatttataccttcctgggtttattttataattactttttatgaatgctatttcttcttctttgtgggtcttaagatgcttaaggctttttggttttgagatttttctcatatttccatttatttggcagtgaattcatctcctattattagttttgtaacctttcttagaattagttttttcacatgcttcaaaatgttcgcttgcaataggaattctgtgttttgttcttcccactgcattaacctcccagacccacccgcaccctcccaggattttgtcattgctcccatctggccttctagagtacccagtcccaaatgaggcttgctctgacagctccgaggttctgaaatgccaaaacggaggagttagccagtccagtcattggcccagggcctggcccaggaactacctttgagcctccctttgcccccttttgccctcttaggcatgcaggtcttgctagccttagccctggtagcagttccagtattttgcagccacctgtcacaggtggctggatctgccctcgctcccagttcccatagcccctgacgcaagtgagatgctttgggctctcaggtcctttgcccatgtcagagcccagaggtgtggtctcactatgctgtggaaccccagctgacagaaccactcactgcccagggatcctcagggaggttgagaagggaaagcagattgctttaaaggccgccgttataaagccatagccaaagcagctgtggcctgtgaaatggacctacgagaaacacagcaagagagaaggtgtgaaaaccaggagcgcctctcagtccctgcatgaggaagcaatgtgactgtttgatggccctgagttatgtgggggtcatacaggccccttagctatatcatcattccaacagcacaaagacatgaaaaaacctacagtttgcaagcagctgccccagagacagactggcaacaccatgaggccaaatcatacaattgcacagagaaggcagcccttctgtgtgcctgtgcagccttcctccctcaactggcattgcacctagggcaggccctatgtccaaagtgagcagtgatatcagggttacttgcccaggtcactgaccagtaaacgacatgtatgtgtcaccggtcagttgctattggtataaacacttcttctgtaatatatatggcctagtatccatttgggatggttccaaaccataagttggggttctccaggtttggaatggtgcatttcagaaggtaaaaataccagaaattagactacaagaaaatgatgtgttagagaggagtgtggggtaaggagactaacagcagagaggcaggcaagattcaacattttgagatttattttgtgttattggcaagccttcataggctttttagcagggtactaacaaggaaatatttaggaagaaaactggtagccacatggatgagctgttggagagaaagagactagagacagtgtctggagtcaggccagccccaggttccagttttatactcctctgtaggtgcttttgttccaaccttggtccagattcactcctaaattcatcagggtttccactccttgaagtcaaagaggtctaatgaacacagcactttatgcatattacctttctcagccatcaaatcattacaaattagaacttggaactggagagagcaagttacttgcctaaggacacagctattagacaggtgtatgggcttcccaagtgatgcaccaatcctccctctccccaagcaggatgcagagggcagcaagggaggggttccaaatgggtgatgtggtgctctcgcagcaacccaaggctcaggttcagctctagccctcagtactgagctaaaactggccaggtgcagtggctcatgcttgtaatcccgtcactttgggaggccgagttgggcagatcacttaaaggtcaggaatttgagaccagcctggccaacatggtaaaaccccatctctactaaaaatacaaaaaaaaaattagccaggtgtggtggtgtgcacccatagtcccagctactcaggaggctgaggtgggagaattgcttgaacctgggaggcggaggttgcagtgagccaagatcacaccactgcactccagcctaggcaacaaagtgagaccttgtctcaaaaaaaaaaaaaaaaaaaaaaagaaaagaaaataaaaagaaaaaagacagtactgagctaaaactgaagacagttagggaggccctggtcatcctctcaccccttctcccttcatgtccattcacccccagccccaagcccagccagtggtcactggggccacacgtccccatctttgtgctttgcacatgggtcctctgacccagctgcctcccacctggatctgcctgaagaactcttcaatatacagcttctgttatcagacgctcatttcggggggacagctgccacaagtgtggcctctgcagccagagatccaagttcaaatcctgattctgcctctagtgagctgtgtgatcacagtcaagttatttcacttctctgaatctcagcttttcatctgcaaaagctgtcccaaggtcattttaataaatgcatacaatagctgctgcgaagcgctcagtattgctgagaactactggcgtctataaagttctgagtcagggttaacagctgtggcatgtatggtaattgtttgcttgcgaatcatccttcccctcagctgcctgtgagttcctcagggagaggagccatctttgattcagggctatgttccagtgcctgaaataaggcatacctcggaaatgcttgttaaacaaaggaaggaacgtgagagtgaatgatgacaactctctttgccaaacattctaccagtgactcctttgcgaaaactggctgcaggatggtgattttgatttgctgtaaacctagtgccaattgcttccatctgagctttagataggtgaagagcctcccctcgccccgggagtgtcacatctatagccagggcaccgtggataatccattaacacggattccctctctgcagcctcaatgaccctgtcagttcccagctgctaagaggttgcctcagccatgacctgggaccatgaccatcatacctgattcacctggacctcccacttggacaccctacctggacaccccacctgggaatcctacctggacatcccacctggacattccacctggacatcccacctggacatcccacctgaacatcacagcttttgccttcctggcttcagaaaacctaaagccaagcctggccacaccctgggagtagcagagctttggcctcacagaagcagcagatgtggagccaaactttactgtggcctgaggacctggctttgaacctagctctgctaactgactttatcaccttgggcaacttacttagcctttggggacttgatgtccatttatctaaaatggaaatagtgctagctatcgcttcttgagcactcatcaaattgacagggaaaggcctcattgttatttctattcagcatcgccttctcaggagcatgggtccaggtttctggaggatacctgaggaccaggagccctgatgtgtgggccgcacgcccacgtccctgcccagacaggcctcccctcacattgcaatttcagtccttggctgaaattcagtcccttggctattatactgctcccaggtggggaggagttgagagttagagacaggaaagaccaagaagaggaaggtgggagaagactcctctctgtgtttataaaaatgcttttggatgcctgctagcatcagaaagattttagctgccaattaacaaacagtggccacagctgaaggtgacaagatgttccttgcatcttaagctgatgctactgtttgcaagacatgagccttacattatgtcaaaaggtgtttactgaatgaatggatgaatggatccatcagctcacaggattaattaagattttcatcatctgaatgtgaaattatgtccatgtgcagagcctccattcctgcccagcggcttcatcacagccaggtccctgtctctcctgggtcccctcaatggctctccttcctcccaggtgtctggggaaggacagcagcagtaatccagggacagcctttatagcggatgaagcactctgccagacaccgctgccctatctctataggattctcatctccactgggagaaaaatacttactattataagctgcctcaaattatttccaacaccactaaggaactcatggtaaaatataaactcaataaagagctgggtatggctcttaccctgaggatagggtgcagctgcgagctgactgttctgagctctgccttagaacagagtggcagtgtttcctagtgcccaggtgactctctctgctgggcctgctgtggctcagccctagatccaacaaagagagggcaggagcacagcctaggccttcttctggcatcccagctcactgtgggttgcaactcaccagtgggtgtgaaatccatcacgactgagaccagtaagtttttaatgaaatgaaatacaaaaaaaaaaaaagttagagtttgtatatgcgtgcatactgtgtcacaccgtaatttgttttttttttgttgttgttttttaattttattattattatactttaagttttaggatacatgtgcacaacgtgcaggtttgttacatatgtatacatgtgccatgttggtgtgctgcacccattaactcgtcatttagcattaggtatatctcctaatgctatccctccccccaccccacagcagtccccagtgtgtgatgttccccttcctgtgtccaactgttcgcactgttcaattcccacctatgagtgagaacatgcggtgtttggttttttgtccttgcaatagtttgctgagaatgatggtttccagcttcatccatgtccctacaaaggacatgaactcatcattttttatggctgcatagtatcccatggtgtatatgtgccacattttcttaatccagtctatcattgttgtacatttgggttggttccaagtctttgctattgtgaatagtgccgcaataagcatacatgtgcatgtgtctttatagcagcatgatttataatcctttgggtatatagccagtaatgggatggctgggtcaaatggtatttccagttctagattcctgaggaatcgccacactgacttccacaagggttgaactagtttacagtcccaccaacagtgtaaaagtgttcctatttctccacaacctctccagcacctgttgtctcctgactttttaatgatcgccattctaactggtgtgagatggtatctcattgtggttttgatttgcatttctctgatggccagtgatgatgagcattttttcatgtgttttttggctgcataaatgtcttcttttgagaagtgtctgttcatatccttcgcccactttttgatggggttgtttgttttttcttgtaaatttgtttgagtcataatttgttttttgttgttgttttgctattttttgagacagagtctctgttgcccaggctggagtgcaatggcacaatctcagctcactgcaacttctgcctcccaggttcaagtgattgtcctgcctcagtcacccgagtagctgggattagaggcacccaccaccacacccagctaatttttgtatttttagtggagatggggtttcaccatgttggtgagacgagtctcaaactcctgacctcaggtgatccacccgcctcagcctcccaaagtgctgggattacaggcgtgagccgccatgcctgacaggtaatttgtatttctaactgtagattgtagtcaaagtttgaacgggtcagccatgcgcacaatgccagcctgcctacaaatgtagactggggcctttgactcatgcctgtaatcacaatattttgggatgtcgaggcaggcagatcacctgaggtcaggagttcaagaccagtctggccaacatggtgaaaccccatctctactaaaagtacacaaattagctggatgtgttggtccacaccagtaatcccagctactcaaaggctgaggcacaagaatcacttgaacccgggaggtggaggttgcagtgaatcaagatcatgccattgcactgcagcctgggcgacagtgtgagactctgtcccaaaaaaaagaaaaaaaaagagtaggttgggaagccagtaactaggaacaggctccatttaatccatcacaaaaagaggatttgagcagagaaggcaaagacaaacccttgggcaggcagcatctgctctgctggacaagctgttttcaaccatacctaatgatggaagcagggactacattgtccaaagcaaggatcttgggacccagtgggggctcaacgcagcaaagggctgctgatatgctcatctaagatcctgatgggtgcccgtttcttacagaactgtgtgctcacagctgtgctcagtgggccacatggtcctgcccgtctggccagcccatcttggttccactgtgttcctggagtccttactgctaggctctggctgatgctagcccctgtgatgggctgcccgccccacatttcccctggctggtctccactctctcggctactccctgctctgtcccataaaagcactcaaggcagccttctcatctagatcattctttaggcctggagttctttaatctgagggcttttgcacaccctgaattggatgcaaaagggggtatttgtcccatgtgtgtttttctgggaaaaggactcacaattttaccagactctcaaaagcatctgtgccctcagcaaaagccccaagccctgcctcaggaagcctgatctgctcaggctgggtgactatctgtccgtgtctgtcccccccaaagtggcgttcagcaactgatgctggggcaaactgccctgccatctgccagaatgtaaagcatcagctgtgtggaggatgggcggggggctggaccccagccaggccctttcaaaggcactaggggtttggctctagcatgcatccctgttgtgggtggcaaaaaccactaccgggagtcaggctgagctggcttaaatcccagttctgtctctggctcattctgcctccataggcacctgtttaacctctgtgaggctctgatttctcatctagaaaatgccgataagaagatgtaccttccaggattattgtggcaattaaatgagatactgtaagaacagccactttaccgcctataaatgctattttttttaattgactcagtgaaaaacattttaccattttaaataccctcaacccctgaagcactgcagctcttagctctatgacctcaggaaaattacttatttctgtcaactgtcctacttctgacaaatggggatggcttcatgttggtgttcgcaagatgacaagtcaacacgtaggaagcacttgaagcagggcctgggtccttgtacagtcttgcactgttatttctgcaagaaaggagtggcaggtgaagagtccctcccttagactgtgcctaggagcaaaattgccatttctgtctgtcttagtccattttttgttgctataaaggaatacctgaggctgaatactttataaacaaaggaggtttctttggctcacagttctgctgggtggaaggttcaagactgggcctctggtgagggcctcaggctgcttccactcatggcagaaggtgagggggagccggtgtgtgtagagattgcatggtgagagaggaaacaagagggaaagagagtggtgcctagctctttaacaccagctctcacaggagctaatagagtgagaactcactcactacctctaggacagcaccaagccattcatgaggaacttggccccatgacccaagcacctctcaattaggccccacctccaacagtagggttcagttgttcttcctgcctcctgagatggagtcttgctctgtcgccaggctggagtgcagtggcgtgatcttggctcactgtaacctccgcctcccgggttcaagcgattcttctgcctcagcctcccgagtagctgggactacaggcatgtgctaccacggctggctaatttttgtattttcagtagagacggggtttcaccatgttggccaggatggcctcgatcttctgacctcgtgatccgcccacctcagcctcccaaagtcctgggattacagacataagctattgcgcctggcctaggggttcacatttcaacatgaggtttgaggggacagacattcaaactatagcactctctctccttgcctctccttgccgatgggccaccagaaatctctcttcccttcttcaccaaacactgctccacctagacagtggtgcagttgccagaaggcacatgttgcctagcacagaacctcccattctgtccgttttattggcactgtgggctcaaatgctaatgaaacacatggcaagacctcgaattcagtccccatttggttggtgaggaagaggccctactcactgactttgcattcatcacctctgaccccatcacgacctctgagacagagccaagaagcccattttatagatgaagaaaccaagcctgagtggggtaagcacttgcccaaggttacacagctggcaaagggcagtgaggtctgcctagacctcacttgctcctccatgccatgaagctctcttattcacctctttgttagcaaatgtcttaaaagcatttgaagtgcctgaaatgtcaaaatccagctggcatccccattagggagggctcatccactgagtggacagattatggtgacaggtacctgccccggtcttcccacacaccccagcaaggggtcatatgtactctcttccacagattgcacctcccgagttttctctctctcacacctcccttctcaccaccatacccttgacccagtaatttctcagaccctacatgtctccaccagcccacgtgcccattagactcaaggagaggaaacggcagaggttcaacctagcaagcccaagctctgggttttctggctttccctgagtgattgtggcagggggtgggtcactgaaggttatcagcatatcactggcttgaccctgggtgggaggcagggagggcttcccgctttgaggcgccccacccccacccctgtgaacagggtaattatggatagactgggctgagtgatggcctggggtctcgggcatctgcaggctgcccccaggctgaagcatgcctgccagtggcttttaggcccatatgagctggagggtccttccttccttcccaggctcacagaacccctgtggggctgctgtgagtcctgtgaggccacccactaagctgccaccccagccaggcagccttggtaggaacagcccagaccaaagggagattggagccaggaaattccacggtggtgggactggcctgctgtatgcacagattcaggctctaggaggccctgggaagggaagggccctgcccacacccacagtccctcagggcaccccctggctaggcttgtgtttcccccctaagaagacctttacagagcccaggctggagtcctggacgtgggtgcaggaagggaactcagagcttccaggcggggctggcagccacacctctgctgctcctctgccaggccctggcatggcagagccagcctgggcggggaacggcaagaggagcaggaagcagagagagggtttctgtgggggtgtaaccgcccaaggggttctcctcacctgctgcccagatagccgatttatcatgacaggagaattgtaatagagaaagactaattcatgcagagccagctgtatgagagaccagagttttatgattactcaaatttttaagtctccctgaaaattctgagactcaggtttttaaggataatttggtgggtagggagtcggaaagtggggagtgctgattggtggagtcagaaataaaatcatagagtgtcaaagtgggattattttgctgtcttcattcggttcctgggtggcatcgcagaactggttgagccagagtaccggtctgggtgcctgctggtgcattggaacacagggtctgcaaaatagctctagcattaatctgagtttttacaacagtgacgttagccccaggagcagtttggggaggttccaaatcttgcagcccctggctgcgtgactcctaaaccgtaatttctaatattgtgactaatttgttagtccttcaaaggcagactggtccccaggcaagaagccaagaagcggggttgtttcaggaaagggctcttatcatttttgttgcaaagtaaaactataaactaaatttctcccaaaattagttctacctacccccaggaatgaacaaggatcgcttggaggttagaagcaagatggagtccgttaggtcggatctctttcactgccatcattttctcactgttataatttttgcaaagtcattttcagggggaggaggagtttcagtgctggggcttggaatggcctggcatcctgccccaaggagcccaggaacccacctcgggctgcaatgggatcagagctggttcaggggtaagggtcatgtccagaacaccctgggactggcatggaaagccctggaggaatggcagcaagggccatgcgtcagaggcccatatctggccacccattttactcaacatggggccagagtcctgagggcagtgacttgctaagaccacacagaaagaatgggggtgagtgggaggagtagtgtcttccagattgagcctgcggaccagaggcagcctgagggtgtgaaagggccgtggccaaagagcactaaccctgctcaaaggtggccctctttgggccgggtctcaccagcagccagtgagcgctgtggtttccaagcaagctattcggagtgcaagccgtctgaggaggccccacatccaaacacagacacaggcatgagcgcgtgtgtgcattcacacacacacatgagcacgcccatgcacaccccgcaccatgcacacacacatacacacatttcaaccagaagaatttctcttttctctcttctgtatcagattttgatgactgaagccaataaaattgcttttttaaaaaggcagtggccacagaagaatgggcacctttgggagtcagaagccactgcaactccatgtcagggcacttacagctctaagattgctgaggtcaggaagtggcgagccgggttcacataccacacacataactcacaccctctatactacacataccccacacacaaacacacatcacacacacaaccacacacaatacatacaccccacacacacacatcacacacacagccacacatatcacacacaaccacacacatcacatacacataattgcacatgatacacacaccccacacacaaacacacacatcgcacacacaaccacacatgccacacacacaaccacacacatcgcatacacacaatcacacacaatacacataccccacatacaaacacacatatcacacaaccacacacctcacaccacatacacaccacatacatcacataccacacacaccacatataaccatacacatcacatacatcacacaactgcatacaaccacacacaatacacaaccacacatatcacatacatcacagtcacatacacacaaccacacaaaatacacacacccccacacaaacacacaaccacacatatcacacaaccacacacactacacaccacccatacaaccacacacatcgcatacacacaaccacacagaccacacacaaccacacacatcatacaaccacacacacaaccacacaaccacacacgacatgcacaccacacatataccacacaaaccacacagaaccatacacatcttattcatcacacatcaatcacacactacacacaaccacacacactacacacaccctacacacaaatccaaaaccacacacatcataaaaccacacataccacacaccacacaaccacacacatcacatacatacaacacacatataccacacacaccacatacaaccacacacatcacataatcgcatacaataacacactgcacacaaccatacacaatacacacactccacatacctcacacacaaattcacaaccacatacgtcacacacacaaccacacacaccacaaccacacacatcacattcatcatacatcacacaatcacacacaaccacacaccacacacagtgcacacaccccacacacatacacacaccccaaacagtacaccacacgtgaaacacatgccactcacataccctacacaatacaacacacacacaaaatacacacacagcatacacacatcacacacaccacataacacagcacgcactacacacctcacacaccacacataccacacacactctacataatacgtcacacataccacacaacacacacacttccacacaatataccacatacacaccgcacatacaccatactcacatgtgccacacacataccccacatgatatatcacataaacacacacacacttaatttggcatagtcagcaagataagtgagtacagtacctgcacgtgaaattggcatttggaagccccgggatgctcctggggacggaggactgcggggagaagacaatgtgactggggagcaccggccattggggaggagatggtgcgaccggggagaaccaggagtgtttggagggacaccccaagaaacgggtttccatgccctgtgtgatagcaaaggtgctccttagacccatcctgtgctcaatctaggactggagtgccagaaaccagacctaaaggcattggaagggaaatacagagatcctagcacaaggagtgaacagtgaggggaagaaggagcctccgaataggcctggagactggaattgccagcgttacacatttctaaattgtttttctgatgctctctctaagaggggaggcactatcactcttggataaaggcacagtgttacaatgtccttctgatggcacacttgcccaccttagctttaacctcacagaaggtgtgcttctgccaattgctatgcattgaccagcagtcatagtggagctgacaccaaggagctgttttctttgcctctgattccttctcaaaattgcaccaaatatttgccatggcttctggctggaagtaggaatgttgttctgaacaatattatggggtggcggtgagatggacttgagaggcatcccggactcatgactcatctctttccctgcatccccagaatcctgtcacattactcttaatggtccagaaaatacaaggactcctcgaaggatgaaagaagggatttggtgagcagaggaaactataacccacactgtgtgcagtggaggaccagtgagaaagtgtggggggcttatggagtgcttccagcagggaagaggcacgtagaaggagcagagggccctggagccacagcaggcaaacctcttgggaatatgagacaaaatactacacatacgaaaccacatttgttcattctccttgccagcagaattttacgaagcccctgactcagtggctgagtgcagccctccagaagaatgccctgaagatgataagcaggatagagcacaggctgccatctctcttgcctaaatcactacattttaagaaaaagataagttcaatgatcctagcttttgcctcttcttgtacataagacaatgttcaagaggattagagattatgcttctataatctataaccaggtgcacccaaacattgaggagattctgctctaatgtaacttctgagcacatgcaaaacctccactgccagtatagaagctgtgggctgccacattgctttggagcagtctagcagaagttctgtgaaaggctctcctgggttgcaatcctcagtgagacttctgaataaaactaactttaattatcgaaaagcctgatttttttctttcattgacaggaaccagagttgagattgttggctctgtcctccttcacccagcagcaggcaactttgggagcgggcacttgagtaggagtgtgaaggtagccccagaagcactggggacctcccatgcatagaacactaactactggcacactcagcccagtagaattctctccacctccccagccctggagacagccttcactgcttgcaggtaacaaagataatgctcactgaaggatctcagagaaccttaggtcaaagacaggtattcaaacaagacataaacaattgtgaaaaaagtcacaattgaataccagcaccaaggaaatagagttaattgaatgaagagattttatttatttatttatttatttatttatttatttttactttttgagatgaaatctctctctggcgcccaggctggagttcagtggcgcgatctcggctcactgcaacctctgtctcccgggttcaagcgattgtcctacctcagcctcccgagtagctgggattataggcgcagcaccaccatgcccggctaatttttgtatttgcagtagagacggggtttcaccatgttggccaggctggtctcaaactcctgatctcaagtgatctgcctgactcggcctcccaaagtgctgggattacaggcgtgatccactgtgcccagcctgaagaagagattttagaagaaggaaatatctcaagaggaatgaaagtatatcaagaacaagtgattatagaaatgaaataattagatcttggcaatgaaagatatgattgtcaaaataaactaaataacttaatgattaggattagtatcatgataacatacatagagaattagtgatgtagaagaacaaggcaagggatactccagaattcagtgcaaaaagatagaaaggctgctagtggtctaccagattccagtttcctcttctttcagagtacaaggctggactacatgcaggttgatatggccacgtggctaaattctgtccaatgaatgtgagtagggggtctgtgtgctgctgatgaactaagggcgtgccttctccctgctgtcctgcttcccactgcctatagccagctctgcaagcaggtgaggatggcacactagagatgtcagagaaatggaatggagggagatttgagcttgtcaatgtcaaataaaagataaaataaaagattagagatgaatgtctaatgaatgtctaaatttaaaacattttatttggaagcaagaattgcaaattggggcatacacacagagtgggtagtcttaggtctgttcaaagaacaaagaaaagatgggaggttttacaaaaaggataaatgttatgtatcatttgaaagaaagttattttgcattagtaaagttttggagagctggtggctctgactagtgagggatggtggtgggtagagtcacagcagattgttttagtagctgttagataaaactggtttcaggttacaacaggaagcttcagcagttgagcttgtgaaaaatgtaattcttggagcaggtgccatgtgcctcaagtaattttcccccccgggcccttcaatttggatttagtcaggtgtaataggaatggcccaatttgcataatcttctttcttatggctcccttttgatcaagatctttctccaaaaccattgctgatcaaccatactgtcttgggaaaagctgtctatcccatgaaaaacatcaatttctcattctggtgtgcagtttgaatgcctctggttatggcatcaggccttttggtgaactttctgtgtggcacatacatcagtcatgagacatgttccttaaaatttgtctactttcagctttagaaatagaacagttcatgttttggtaattttatgagggaaagttggattagaggaacccagaagaatttaggtctatactagtctataggtaaatagcaagaactcaaacacaatgtagagttatcatttattaagaggcatattataactttactttagaaacacaggttttaaaatttttaacattgatcacgtaagaacctcagatttaaaactttgagactgggaagccaaactgaggcagactttagattttgcttacagttttaaggttcctgtgccaggaaatgacaattttaatgtactcattgtaaggctggtaacccttgaagtcaggcattttgtgcattcttcaaatatgacattttagtcaaagccttggtaatataatcaattatattctgctatagaaagagaatggattttttttttttttttttttttttttttttttttttttagatgtggtctcgctctgtctcccaggctcactctcccaggaatgcagtggcatgatcttggctcactgcaatctctgcctctcaggttcaatcaattcctgtgcctcagcctcccgagtagctgggattacaagtgtgaaccacaatgatcagctaatttttgtatttttttttagtatagatggagttttgccatgttggccaggtgggtcttgagctcctgacctcaggtgatccgcccgccttggcctcccaaagtgctgggattacaggcacgagccattgtgccccgctgaagagaatggattttcattgcacttaggcaaataatcatattgccataagaatactcacaaatagtttttgaattctggaagaatcaagtaaggagaaaacaccaaatgcttttatctttgtttaaaaaagtatactttatcaaattgctgtaaattatagataaagagaaattttttccttaaatctggagaacaaaatatttaagacaagaatcaacaatgttttaaataaaagttataaaaatattatttttttttgagatagagtctcgtttggtcacccaggctgaagtgcagtggcatgatctcagctcattataacctccgcctcctgggttcaaactattctcctgcctcagcctcctgagtaactggaattacaggtgctcaccaccactgttcctctgttgcccaggccagagtgcagtggcacgatctcagctcactgcaagctctgcctcctgggttcacaccattctcctgcctcagcctcccaaataggtgggactacaggtgcccaccaccacgcctggctaattttttgtatttttagtagagatggggtttcactgtgttagccaggatggtcttgatctcctgacgtcgtgatccacccatctcggcctcccaaagtgctgggcgtgagccaccatgcctggccaaaaatatctttatcaattacttaattcatgtaattaatttttgtcctgattgatcttgattactagtttcatgaacccatcaatttatttagtagagatctggacatttttatttagtctattgatcttaaagttaacagaaacctgtatttaagagtatttattagaatcttttccattaatctgattgtaaatgtttttagagaagaattcaaaactgtggatgacaaaaacttagaatagccatagttaaaaatctgacgaaagtttataatcaacaaggaaatttcgttatttctattatatatagcattttaagataaccagaattatgactaagacatatttctataaatttgtttatacttttttctttttttctcatctgatatttttataaatttacagaattttcagaactttcatatcaacaacataccaataaatgcaactaaaagaagatctagtatcacttatcatttgacaatgttttttgtatgatttaccaaataacagtaatcatttaatatccccatctacaagatgagaggtatatctcttgagactttccagggaccaaattagaaaaatcccaaggttaattctaggtcatgaagacttaggttaggatttgattttggggaagtttgtcaatgatgtaaaaaacttaaaatatttgattgaaacagaatcacagatcactgaaaaataatagtcattcacttaactaaagcgatagttgaggtttcagaagcaatatagaaagttacatggatgtaaacaccttaacctttttcaatatcagtttttctaagtaatcaaaaacctaataaagacaacacaataaattatcttgataaaatggttttttttttttttggctcagtaaccaaaaagttaaaaagaaaatctgcagaatgactgtttctccttaccagaatctcactaatataacctggaagttgaacctaatgaaaaatatacttgattttaatcctacacaggaagaatatgtccaagattgtgagtatacactatattatagaagaatgtaaacaagaaaactagtaccttgagaaagaaaatacatggctcttagtaacagcatggaaaagcttcctggttacatggtacaattcagacatattgagaaaagccaagagtatagaatcaaattatactggaggaaaacattgcttttctaggcttttaagagaaacacttcagcatcagaccataatagcagaggtagaactggcgggaaaaaaaaaagatgtaagagttgacaaaaaaggttgaaggagagaattatcaccccagccaagcaaaaaatacaccttttcaaggggagaaagttcagaaggcaaggatcttttgctgcaagtcatgtgctgcaaggtacagcagaagttgaacttctgagacaaaaatttgagaaatttcaaaaggaaaactttacctcaaggaatgaattaccattgtaaataaagaggaccatatttttaagccaaaactagggaaattaattagatctcaggaaatgtggcagatactgacactggctgcagtttagaagattgttgttaaaaaaaaacagattttagaattaaaaataaaacccttttgcaattttattaagagcagaccaatacttcaaaaaaactttgttgttctaaatagggggccacatttttttggtttagtattagtgtatttttagtatcaaattttaatctttagaaacatttataaataattcccttctaattataaacaacttgatcatacacaaaatttatttcataacttccccctttatgaacctttttatgacttacttggaccatagttgacatacttgttttttttgcttttttctatacatcctgtttcttaaataactagtcgttttgctttaggacaacaatttaccacataagagtctttctcaaataaattatttttttcatattacttatattttgattaataaacctaaatatatttagtattattataaaattgaagaagccaagaacaaacttatatttatttagcaatttgttggttttttcttatttggatatgaaccggacatttaatgagtacctattatttaatttaccataactttaagattttagattacatgaaaagtttatttataaatgtttattctatttatagtcacctaatctttttaacaattatatctagagtttatatgtataatcatctaattttttttaacaactatatctagagtttactatgaaaattgaggtattagagctagtcattaagttcttttattagccaacttggtagcctgttaatatcaagtgtttacctaagtaagagccttaaagttaaataaatgggtatttggttgataactcacaagctatagctgtttttattgaatcaacaatattaaaataatcttacttatcaaagaattgcacaaaaatcattctgttttaggctgggttcacagctttataaccttaaaggatctaacagaagcaaataaactgtctaatcagttcacccaggcaaaaaatatatgttgacaattttgggacatttctaattttatgttatcaacaattttgaagccaattaatatatccaatatttacttaagtcatgtgaacgaaaaaaatttttgttcattgctgtatattttatatgagtgctcatttatctaaatagaattctttaaggaatttttggccagctatgccagattttgccatgtagacacaacataaaacacaatacatgtacatatgtgtaaacacatctaaacacatatacacacacaccaagatcttacagcatcagcagtaagcaaataactgtggaaatgactttaaataggcgtagttaaaaacagaattgacaagaaaatttggttatttctgtggtttacaataacttaacataataactatgattgatagcatatactcagacatattagaattttagaaaccccatataattttggaacatatattaatatcattcactaaaatatagcctgaagaaggttaaacattagtttttattttgacaatgcttctcatgtaacttaacatgtcaaataatcctgttaacctctcttttggatgcttcaggggccctctgtagcacctcaaagttagaggtcagaaaagacaattttgaagctgaaatttgattttgggaagcttatcaaatatgttattaaggtttaaaacacttaatattatgaaatagaatcccaggtcaacataagtcattcatttagccaaaatgatgactcaaaaatataaaaggcataaacctttactcattgatggagggaagacttagctttccaaacaatctgtctcgtctttcccttctttttttggtagtttattcaaaaggcaaacaaaaatgtttcatttttaaaaatatagcataaaaatcttgttcaagagagaaagccaattttagcattgcattagtgcattattgatgtcaaaccccattcttaataaaaccttatagacaaatatgttcaattttaatgtctgactataagataagattctcataagtcttttttataaccctttaccatttttgttaaagagcagatcagtgctctaaggaaactgttgtggttttattccaatgttcaatttacagaaaaaactgagtaatacccctttaaatttagccaatatgttcatacatagaatctctgttacaattaatttttcacaactgtttcacaacttgttcaaacctttagctttatcctaatttaaaacaatactttaaccctctaaactaggcaaaaatttacatttccatgccttgttataatcttttagtaaaagcacattttgctttcctcatacactttgcatgtacaactttttttagtagtcttaattacatgttacaatgttaattcttagcaatattaatttttggtgaaaaccctgttaagtaagtgattttaattacgtactaggtttggagcctaggacaccagacagaagtacagataaggtctgacccttttcagcatagctaggggagtggttaattccacatgtccttaggtctgacctagctgttaagcaggcaagttgaacaattttcaaaagccaaagaagcagtttatgaccttaaagcatttagtaaacctaatatctgacctacctaatttatttacttattttattttattattattttttttgagatggagtcttgctctgccgcccaggctggagtgcagtgttgcgatcctggctcactgcaacctccacctcccgggctcaagcaattctcctgcctcagcctcctgagtagctgggattacaagcatgtgccaccatgtccggctaatttttgtatttttagtagagatggggctttaccgcgttggccaggctggtcttgaactcctgactccagggatctgcctgccttggcttcccaaagtgctgtgattatgagcatgagccactgcacccagcctgacctacctaatttagaccaaatgtctttattttaccagtaatctttaaaactgtttttatttctcagagattactaaagtcacgtgaactacaaggcattacagttttttctttcaaaatattttatttaagccttatttttctttaagccaattacttagagttcatttatataaacatcacacacacgacacatatataactacacagatagaaaaagatccactagttgtaagatttttcatttgccagtttttaagtttcttaattagattactggcttcagggtggggtccttcaaggagcagggccaggaaaggatgcggtttctaggacctaataaggaggcacaactgaatgacaaaaacagatctccaaaattaagggtcccatttttatattacatcccagatccctaaaaagaggaaaatgctatagaagacagtgcaatgcttttaccatgcatttaattgcatggcaacccaaagccaatcagcccattttgcaatcagcctgtcccccgtgagagtcaattaatttgactcctagtagggggtggggatttttccgtaccttctaggtggccaagagcatgcttctctgattcaagcatggttagtatccccccataactgccattaaccatctctaaaagtatatttcctacctagttattacacacgaaagttctcttataatgcaagtaatttttgatacccccaaaactgaaaaccttcagataacacaatgcaaaatctatttactttcaattcctggggtttcatgaggaaaatcgagattttttcccaaaaccgggtctatggcacttcctctgtttttcctaaggagtcccagactattggaagttatcttaggtcttctcatgtgtgcattaagtgtggcaagaagacaaaatggagaaaaacaattcagttgactgagaagaaaaaacaaacaaacctattttcttcagaaaaataagatccaagaagggaataaaaacccataaaggccatttaaatatacatatagcttggatatatgtatccaagtcagctttaattaaactgacttttaaccacagcactcacaaaaatgttcttttaatttctcattactctagtttagccagggcaaacagccaatatatctggcttttaaactttaccgtaagtaactctacgagtgaaaccaacaaacctcaactaaggttatgacttaaccatgagtgtatgaggtattttcaatttttacaaaattaagaatcttcaaaggtagctcagagaaaggaaaatttaagaagggaagccagaagttgttaatggaggggaagggaatcaacaaacggtaaaggtcacagagatgtccaccagaatgtactcattctgtaagctaggatagaacccaggctgccattataaaatggcaaacccttagctgctgagctaaaacattgggcagtttccactgcttttcccacaaagagtctagagcaatcaattttgagcttgcaatggcttttaactactcaaaataatttttagagctaactatgatatgagccccaaaattccttttccctagatggcagagaccaagagaaagtactgccacactgttacaaggtcaagctcccaaggacataaaacaagatggagacctcattcagttttctgcttgtttcaggaatctgtagcaaagtttgtaaccataggcaaaagcctctcaattttgcaagttgccacccaactagctgcatggaggacccaaattaatgttttccattctggccagagaaaaatacatgtgacaaaacatagacattagccactctgcttagcacccactatcgaacttgtgaggctcaaacttgcccccagttggtccctatcatctttaatacattcaaagtggattaaaggagtttcaacatgtgatctttgggcaagatggacgcccttttaacagaaaagaaagggaaagaagagaaagggagaaaagcattgcctgtggcagagtggggaagatgaggagctcagggaggccagagaaagacccacccattgcagggatgctgaatcaaaagttcaggcggctgattgttggtcgtgaaggatcttttcgagcagtcccatcagctcccaaattttcccctttggggagaaaaagttccccacgttctatggcctggtacacgcctaatcctatcacccactggtgttagcaaagagtgcaaggcagatcactccaaagagaatagtggttaaccccatggtgccaaatccacgtttaacaaagagggactttactgagggggaaggcctccaacccaatcccatcctttaccaggtaaaatgaacccactactcacccaaagtcagcccattggtgctgcggtctatttcctttggatcgggatcgtaactaagctaaaaggctagcagatttaattttttaagtcaatgagtcgcataagctttcgatttgccttttgtaaagtctttaaataaaaatactgaaatctttttagaagcttctgcatatcaatagacatccctagatgagactaacttgggagccctcattttcaaatgcacttcagtgcagttttgttcatttggaacattccactctaagttatctttagtaagatttcaccatttctataagactgctgcttccggggcctaccacttatgcaggtattagccagaaggaactcagttcttcagaaattaaggatccaggccgggcgcggtggctcatgcttgtaatcccagcactttgggaggcgaggtgggtggatcacgaggtcaggagatcgagaccatcctggctaacacggtgaaaccccgtctctactaaaaatacaaaaaaaattagccgggcgtggtggcgggtgcttgtagtcccagctacttgggaggctgaggcaggagaatggcgtgaacccgggaggcggagcttgcagtgagccgagatcacgccactgcacttcagcctgggcgacagagcgagactccgtctcaaattaaagaaaaaaaagaaattaaggattcaatttttacctcagattttggctttgctctcaggttcctttgatcaacctagccaatgatttttctcctaccaaagtgcataagaaaaatgaaacaaggccgggtgcagtggctcacacttgttatcccagctctttgggaggccgaggcgggtggatcacctgaggtcaggagttcaagaccagcctggccaacatggtgaaaccccatctctactaaaaatacaaaaaattagcagggcgtggtggtagacgcctgtaatcccagctcctcaggaggctgaggcaggagaatcacttgaatctgggaggcagagagtgcagtgagctgagattgcgccactgcactccagcctgggcaacaaggtgagactgtctcaaaaaaaaaaaaaaaaaaagaaaaagaaacaaaggggtaaaacacaaaaatccctgtgaattttcaatagcctaattttacacccctgcaatattaccatttactacgtttctttctgacccagtcagatgtaagaggcctctaactgtatccaagccagttaattaccagatcaaatccattccttgaaccagcccagtttctgtcatgacttccaaacccagtttggaacagaaatttgctcaaagaaactcggagagctcaaaacacaaatcagtggagctctgacattggagagaaaacttaccatgacttccaactgctctgagagatcaacgaacacaaataggtcctgcaggtacctggcttcagtcactcagcactcctgggagtcgttagaagctctacttcagatctgctctgacaccatctgataaaagaaaaacttcagctgaattaaatttaaaggagcttaagtgagcaggcaatgaatgattcgcgaactgggcagccttctgagccagagtaggctcagagactccagcacagccacgtgatggaggaagatttatggacagagaaaggaaagtgaggtacagaaaacggaggtgaggtacagaaatagctgattggttacagcttggtgttcaccttatttgaacagggttcaaacagttggctacatttgattggccaaaactcattgattagcacaagtgtagactacagtctgtttacacctccacttgttatagttcatgatgtacagaaaaacctttaggctgaacttaaaatatgtaaggaggcagatttaggctaaattgatttattttttattatatttttaagacggagtctcactctgtcactcaggctggagtgcagtggcgtgatctcggctcatcacaacctccatctcctgggtttaagcgattctcctgcctcagcctcccaagtaggtgggactacaggtgtgtgccaccattcctggctattttttgtatttttagtagagatggggtttcaccatgttggccaagctggtttcaaactcctggcctcaggtaatccacctgccttagcctcccaaagtgctgggattagaggtgtgagccaccgcacccggccggctaaacttgatttaacagtacctttggggagataatttttttgtataatggaatagttactctaattataagctgctattatacctcatttggatctgggaattttctcatgtgatgtatgtacacacacacacacacacacacacgactaatattgcaatattcttttttgtctatgtttgtgtgtccttgtagaactttctatagcccagtctggaagtgtagggaaactgtatctgtttcagagtgaaactgctctaggggatgggaaattttgagtttattatttccatgagaaaatggaatggggcttcttttgggggaagatttaaaattatctgtggaaaaaagtgagttggacttggtaatgtaagatgagaaatttttcattattatattcaatgagatagacacaaatactggtttccttaatatttctgaaattgtatcattgactatgatagatgagactactgttcaaacatattcactcttctacctctccatttcactggaagagtgtagttactggttctattaatgttgggcatggctctgacttgctttggcctcagggtaggtgggggacagttctttgcctctcgactgtgctcagccatgtagcttgctttggtcaatggatgttagcagatgtgactcacggaggaatggaaattaccttgcatagctgggcttgtcctcttgaactgctgccatctccatgcataacacttctttgaactccttcagcctgagccccagatggaatatcagtggagaagtttaaatctcagtgaggagccaagtccagttggactcatagcttgaaacagagctgccccattgagctcgcctaggtcagctagccccagctgacctgcagtcatgtcaattgtatgtcactaagattttgtggctcttttttactcagctttagctaactaatatatcaccatatcagggaattttggtaggacaacatagctaagcacaatttgagatggggaatagaatagggtaaattctctgttcaaagcatatggtaatctggtgcctattttacttattatcccatttgtgcccttttttataacatgtctttggaagcgaaactgtacatccagtgtctctgtaacactgagtctattgtccatgtaacattcagtctactgaactgctttaaaatattagttgaatgacagtagactgaacgaatctctgtagttccagaaggcagggagaaggattgggagagtcgacacaaagtgtgcagccagggctgcgttggtatttttcctctgatgtgctccacagaatggcagctgacccactgtgggttgataatttcactggttcacagaagacagggaatataggactttagggaaataatgtgcctttgtctttgtctttctcttattctctatcaagggggaaaatgctgctctgggctggttggattcaagctcatggattggaccatgggataaagttttagtggcagatggctacttccttgaaatagagtggagaaaaagggtggcagcattggtgagaagggacaggcaggaggcagtagggaagtccagctttactctggagagaagaagaggtgggggtggggagggcagggccagctgtttggggtgggaggcagggaaggtgttggctgcccagttgacatctcttatctctttcctggggccagagtaggttattttacagcccagcctctttatggcctcagcagagaagcaaaggcaaacaaagaacaggtgatccctcagggcccaaggagacgcctcctacagcaggtgtgcccacttcagcagccctgctggccagaatctctacttagaaggcttctcggaaggccaggcccttatcggcttccgactttgaagtcctaggaaccctccctcacacctcccttctatgtggctttgaaaatactttgatattctatccctatcccttaattatttgaaccctcaccagtttgtaatgagcctgaacccatctttgctccattttacatatgacaaaactgaggctggaagcgttgttgccaagcttctttgccctttgtaccatgggatttaattacatatattttatggattctttcctttataaagttgtaatcattcattcttttttaatagagagaaatttagaaaaggaaacaaagcaaaaaatgacctaaaatcctatgggtcagataactcccgttgatattctttccttctttcccccagttctatttccagaggttaccactttcaatttttatttctgtttcattctataaagatgaagaaaatttttgacacctttaaaaatataatttaaatcatcttaaacttatagaaaagttgaaagtgaggataaagaacattaatttttctacgccatttgagagcatgatcccggcaatttgcatgaacaccttgctaccgcctcatctgcaggctccactaaagtttcatcagctgtcccaagatacacaggtttcattctcctgtctctggtctccttcaatctggaatggttctcccttctttccttgacttccatggccttatgtttccagatgacaggccagttattctgtagtgtgtccctcacctgggttgaggctgatgcttcttcagggttggattcacttgcatgcaccttcagcaggaagatcacagaagctgtgctgcgttttccttgcatcctgtcatgtggtgagtaatttcactctaggattagagatggtgttcgctatgatcatttgattacagaggtgactgccagccttctccactgtaaggtgactcttctctttgtaataaacaaatattttgtgatgaggcacactgaaaccatgaatatattccattcctcatcaaactgtcactttactccatcatttagttatattgaaatggactcagatttttattttattcagtaggttattatccatcatcattattatttactttgatgctcacatggtcgaagatttggccatcaagggccccttcaagccaggttctgggcttttctggcctgcacccttcattcttagagtacttcattactttctagctcccaagatctttcaggtttatcttgggctttcccagcccttgccctggaatcagccattttccgaaggagacttggattcttttaatggagaatggcatttagaagtcaatatatgggtgctaggagtgttcattgctattggggtatcactgctcctagactctctcagtggacagagcaaggatatatatgcacacacactattagatcaatatttatctctctatatagaaaaccatgagctcacttcaatactttcaattctaatcaaaaccacagggcttattctgggtttccctccttccatattcatgactgccttctccatgagtgagaaaactggctcccaactttgctcagttggtccccctgcatatacccaatcttccatagcagaactctgcccctccactcattctgtgtggctctgacatccacacttggttgtccccttctgccatgtggactttcatttgacagtacttggactctaacaccctgtgctaggccaccgtgcccctgcctccctgcatggccactctttgtcctattctggctctgacatgccatgccaggctcccccacgccagatgggtgccatctggtacatatcccgtgtgcttagcttagactacccgggctatgatggctactgtcccacccatgcccatgtgctgcatgcatcttatgaaggcatctggtttattctccctgctcatcagttcaatcagcatgtgctaccagtgtagtgcaccagcataccatctgtggatctgtgggatgttcagaagatcaaggtctctgtagaccacactataacagaaagctggaaaacgaacatgatctgggagaagacactgactttgtacttctatccttgccaggtgaaagcaaacttctgctggttcttaccgatatagatggggagaaaacacaagctgagtcaatagctacatattaagtgctgagagtggttaagttgttctatgttgcatttagaaaagcagctaaaattggagttactgcctgattaaatttacgacgacatacagtcattctccaagattcagcaacttcctgcacaggctaaagagctaaagaggtgagccaagtgggcagaaatgtgacaggcctccctgtccctgcatctttcatgtctttaatcatggcatcgatccctgtaattcccctagaaatacagaaatgcaggtttactatttgcgtagggaaagaaaatcccaggctcctgggcctgttcaaccatttctttgacctcatctctccttgcttgattttataccagttgtgctggagtaccttctaatatggtttggctctgtgtccccacccaaatctcatctctaattgtcatctccacatgccgagggaggtacctggtgggaggtaatcggattatgggggcagtttacctcatgctgttctcatgatggtaagtttccacgagatctgatggtttaaaagtgtttgggagtccctagcctctctcctgccgccatgtaagatgtaccttgcttccccctctgccatggttgtaagttttctgaggcctccccagccatgtggaactgcgagtcaattaaagctgttttgtttataaatcacccagtcttaggtagttctttatagcagtgtgaaaatggactaatacacttccttaatgaactctctcagaaaggattcaggaaatgtaagcttgcaagtttagaaatatccttattctacctttacacttgatattatcgctgagataagcgttttaggttcaaaatatatttccaggagtcctaaaaatatagctccatcttttcagagtcttccatcatcctatgttgttgacaagactgagaatggtctctgtctctcctttcctttgtaggcaacctttctcttcctgctcccacccatggaacattttagaatcttcttttttttttttttttttttttttttggtgttttgaaattttgcagtacctgtctaggtgtggagcagttccccgggcttccttttaatctgtagctctggaatactcttgctattgatgattctatgtgtcgactattttgctcacaccccacccagatgcattctctactgtggttctctgctcttccctgtgccaggggaagctgatggctcctttgctggcagggctccagttgggtttggtcaatgggagggactgacaggagactggaagtggaaggagagagaggttggtagaattcttttctacttccccttgcttccatgctgtctggaggcggtggcatgcctccacactacagaagctcccactgggggcccttcctctgcagtcctctggctgtggtaatgtggttttctccttttgttcttttaactgtagggtggtgattgcttctgtcttctgccagtctctgggtgcctcaccatttcttgtttctttcctttaacgcttcccacacctctgtaagttacctttttattaaaatccctttgtttgacaatctgggggtgaattatgtgtcctgtgcagactatgactgatatgctgcctttcattgtcttgatttttccttcctggaaattttagtaattggatgatgggtcattagtgttaatcatccatgtctcttattttagctctgaagttttccatctttctgtgtttttgctctacattatgggatatttcctaagctggttctcccatcccttctaatgatgtgttttcaaatttcagtagtcatgcttagttttcaaggattctttcttgctttcttagtctgtcttatttcacggcaatctgctcttgttatatggattcagtaatttctctaatttaggcattaaaggaagttttggtctcttaaagttattttctattccctaagttatttcagcttcttttggggtcagttattttgtttattcatcttgacctatctcctttgtgctgttgattttctaaatgtgtgaggatctttggttctctgttataagtactggaaaataaactggtttccccggatagctgatgtggcttccctctgctatagccttccatgaaaaaagtaggacagcttccgggagctagctatatgtgagtggaccatgcttggcagctgcccttcagaatgcacaggttgcgggcagggatggccaaggacatttctcagggagctgtgtgtatgggatgggtctctgagaatggagagcttgatgagttcaggccgtggaagcaacatctacacaagcctggatctgagaaactcaaccatactccctgaaaatggagagtttacatgcagaatgagtctgggggaggcagcactagaagggctgaaagaggaagagagtcagactgatttcagagggacccatcctagagggaccactgccatgactccatggggacatttccaaggggagccacaggaggtttcactggagagttgtgtatgtctgtccagtgtctaggaggtgctcaccatggctgagcttgcagggcctcttaggactgtccaggtgagatgtgtgggtcgtgatgagggtttggagaggtttccagctagaattggtcgggacagcccattagctctggggcagaggctcagggaggtgggcaagcatgcaggacacaggaatgcttatagccacagctctgcagggtgtttcttgcccataactgtgtggagagccattctcatctcaactcatttcttgccacaacatctcccgaagcaaactttgttattagctccgctttgcagatgagaatctggggcaatgcgagacggcttctgtgcccggcttgtgaccagtcaccacactgactctcaatgtggtgtaagcaactgtgaatgggcctgattccaaatcccagcaaatttacagtaaggagggtgcctggggtctatccatcccctgactagctgatcttcagcttcctcataggaccagggggaatactgagcatgcagtggactgaggttcagagaggtaatgtggagcgctgcacacacctgagggagttgtgcgcctgtctgacttccgggtgattcatgaggaacattcctgatggggtgggaagggaacctgtcactaagctatttaggagaatcagtctccagcaggtcacaccagccagccacttttatggcagaaggaaaatcctacctagccccttccccagagatggcagaatgcagcctggctgactggcagagcctctcaggctgtgctccggaccctggactccagcaagggggaagaacagcagctcccagttctttcttacagactgctttcttgaggagcttcaagtgctctggctatgattggtgcagggctctgctgcctccagagggtgctgtctcctttccctagcagaggcaaagggtctggcaggcaactctgggagtattggtttaacctgaaatgtctgctaggaagagctacctacccctctcctgggcattatggtcctgaaggaagagcttggactttggattgaaagtccagccctaccatctacaagttggctggctgagacaagacactctacttctttgaggctcagttttctcgcctgtgagatgggatgatcacaccacaccagttaggcatgaggatggactaagggcaggttcacatgcttctgcctggcatgggagctgtttgctgcttttaccaccatttcagctcttctgctgttctctgacccacaagagctagggttcaggctgcgtgccttgcgcagtagttctcaaatgtgtctatgtggaagcttgcctccaagggcttaccagcaaatccagaccccacacagctgccctgcaagaaggaggtgacagtggctgcgttcttgcctgcacagaggacgggtgtccatagagctcccagctggagttgagcagtttctggtcaagcaatgttctctgattttacatgtctggaagctaccattacaatcaggtcttcttaaatgtcctccctccctccgtcttcctttcttcctttctttctttgtcagatgctgtgtgtggacttgtgctgggatctggaggcggagacaagagctgtgacctagacataggggagtggggaacaaaggtgctcaggcagacaaccaactaggctgctacatctgcctctgcagcagagcatgggagggtggtaggaatttgtcatggcagcagggacatcggagctggggtgcaacagaggagcagccgctttccaggtagtcaagacaggaagcagcatggtccagaaagaagagatgacaggtgccagtctacagcgatggtgagcagaggcctgggggcttggcaggtgggttcgcatcctggatctggctgtttcttagctgagtgactttgggcaagttgctcaaccactgagtgtcactttgcttcatcagcacgatgggaataaaaatgcccacctctcagagctgttgtgatgattaactaaggtagtgtctgcagagtctatgcactacaaacggcagctgccattctagagggaccactgccatgacttcatggggacatttccatggggagccacaggaggttcactggacaggtgtgtatgtccagtgtttaggaggtgctcttgaagcagatctgttactctcaggaggttctctaagcacatatgtgactttgccatgtggggatggggggcagggaattataagctagtgtattcaaaacaggagcagcccttgtaagcaaagctgttccattatagccaagtcatgtgcatctcagctccaaaggagaaagtgaccattctcattgaattctcatcgccacaaccttgggactgcctgagataagacactccacttccagggcccaccctgagttttcactcacaccctggatgcccatctccttccctcaccctggctgacattctcagccacactgccctcccctggtctccaggggctgaatgctcccagcctcagggcttttgccgtggctgtgccatccatctggcctatcgaacccatttgctcacagcatctcaccccctgtaataatttatttccctctttccttgtaccctgtctgtcttctcccccagggctgagagctccagaaggaaccaaggacagggagcctgtcttgtccagctctggtgcccagcaggagagccaggctcataggaggtctgcaagtaatgtttctggacgaacttatgaaaggcaggtctttttatacccatttcatggatgaggaaactgaggcagagagagagagagacaggcagacgcacacacccctagacagagagaaacactcctggagaaagagaaagggagggagagagggagggggagggagggagagagagagagagagagagagagaaagaaagaaagaaagaaagaaagaaagaaagaaagaaagaaagaaagaaagaaagagagagagaaagacagcgcagctccagcctgcctgtatccagggttgaggtgggcgtgagagacacacgcaggcagggctgcagttccgggcaggccttgggggctcaagatgcggctccccagggcgagtgctggggtcccggggcaggcgggcggctggagcgctctcgtgggcgggcgcaaggggcaggctgggcgggcgcaggcgggagcgtagcagccgctccactccgcacgcaggcagcatcggggcagcaggagcaggtgaagcaggcgcggctctgccccgcgcctggtgccccctgggcacaggagtgcggccgggggcggggccgagtgggccccggtacgaaccctccgggaagccgggcgcgctgcctgcccttggcccggggcgcagagcgtcacactggatctggggagcatcctacccccactgtggacctcagtctcctcacctgagacatgggcggccccatccgcaccctgtaagccgcaagccaaggaggtaaggggtgcatctgaggtgtctgggcgctatgggcattaggatatagtagcttttgctgagatttcaggagacaaagcaaagggccttccctattctaaccccactgggagattagcattttgtgtatgattcattaattttcctctgattgactgggaaggcaggctgcagggggtccctgttggggcttgcagctggttctagtttttgtatctggagagctgcctggggacaaaatgcagagacaccattttattgaccttgcgtaataatctaccctccccctcatacactcgccacccccttgggtgtgcctgagggacttgaggtcccctggtcctcactggtcagtgtaccccaagcccagcagccccaggcagatgcccaacaccaccttttcagtgctcctcctcctcctgtcttggccctctctgccaatccattttctatatccaagtgatcttactggaatggacctgaccttgctggtctggcccaccactccagcttcatcatctgccaccctggaacctcttattctgcttacttttcccagcaggctctgctccttcctgcctctgtgcctttgcacatgctgttccttgcacttcgagttccctcctctccctgtccctttggctggttgactcctcttcagcctttgagccctgtaccattgccacctcttctctcacctccctgctccctgctccttctctgatctctcaactcacaggcctctctttcatattggtgttggcaatggcaatgagttccatctgcattcgtgctggtcagcccctctgctctgggagggccatgactgtataagtcatctttgcagcccttgtttctagcccagggcttgacacacacttattgagtgggtgaatgaagcagtgagcattttctggagccctcccagcccagtccttccactctgatcctgctttaggtggttggtttgggatgaatggtgtttctccacaccactggccaagccttgctgatggtcacccagagccttgggttctggcccatttgctgcttctgagtgcagtgcctctgccacaggttcatgcagctgggactgctctttatcttatattgggccctgtgtttggctctggaatagtttattttgccatgttcagccccaaatggccctttttgccagaagaccatagtgctggagaaatcttcctgccttcgagatctggttcctaaataaccagactgtaaactatcaggtgaattcacagcttgatcttttaaatgaccaaatgagactcttttttttttttttttttgagacagagtctcgctctgttgcccaggctggagtgcagtggtgcactctctgctgactgcaacctccgcctcccaggttcaagtgattctcctgcttcagcctcccatgtagctgggactacaggcatgcaccaccacacttggctaatttttgtattttcagcggagacggggtttcaccatgttgaccaggcaggtgttgaagtcctgacctcagaaactcatctttataagtagatcagatgcacagcgagtgacattcatgacagccgacaaatagagtttactgagctctggttgattttggccttgtgctctgcaaaaactgccttaacatagcaattgatcatgtaaaaaatacatatggccatgatatgagacttaaagaatatctcgaatagggttttctgctatagtgttttacaagatggggtccaagggccatgtgcatcagaatcacatagtctacttgttaaatacagattcctggcccccatcctggattcacttaactacatctcctggtggaagggccctgggatctgcactttcaacatgcttctagaatgattctgatgtttactgaaggttgagaactgcaaccctgtgggattaataatgactagagaatctgagaggtgagtcacaatgatgtatgtagtggtatggtgcttcccatgcaaaacatccatcattggcactaacacgggggaactctggagtctaaattccaactcagtcttggcagggggtccgttgtgctgaggaggtcctcggagaagggacagcctgtaccagggcatagagatgtggaagagtctggtgtgcttgtgagctgcacactgcatcaagtgacttgaacatagtcatggagtaggttctgtggagggcactgggcacctgtgactttggccaggtatgtctgtgcacatggtgggtagtaggaagaagctggtgtgctgatgagccaggctttgcatactgggcagtcttcagttttgccaggtatcacctaaaaaacaaggctaccagggcagggaggggctgagaccaggagggtgcactgattgtggatccccgaggctttagctctatcttgaagggaatggggtgccgtggaaggacacaagcaatcctgtgcagagtggcatttattgctgtctccattcagataaaatgtgacaaggggcattctacccatgttccctgaacaattccgtcactaaagtctgcatacagcactccaacttttttatcatcagaacagcctcatcctgaggccggagggaattagtagaacaagttctggcattagatgacctgagtttgtaactgggccctgttactaattagctgtgtgactatgggcaagttgctttccatctcagggtcttagattcctcatctatgaaacggattgataatatctacctctaggaataaactagctaatagacgaaagtgctgagcacagtacccagcatgcaacaagtgcttctaacaaggtagcaatcattggatgccaatgtctcaccatgagccttaggtaatagcccctccagataccagccttgggttggaagcagctgagagcctttctacccggccctgctcctctctggattctaccctgggcatgatccctgagtattgtttgtctgtttgccttgtaggcgtcatccctcaagtgtatcacttagttcaagagtcctggaatcttttcacatccactatgaacacctctcacctcctggccttgctgctcccaaaatctccacaaggtgaaaacagaagcaaacccctgggcaccccatacaacttctctgaacattgccaggattccgtggacgtgatggtcttcatcgtcacttcctacagcattgagactgtcgtgggggtcctgggtaacctctgcctgatgtgtgtgactgtgaggcagaaggagaaagccaacgtgaccaacctgcttatcgccaacctggccttctctgacttcctcatgtgcctcctctgccagccgctgaccgccgtctacaccatcatggactactggatctttggagagaccctctgcaagatgtcggccttcatccagtgcatgtcggtgacggtctccatcctctcgctcgtcctcgtggccctggagaggcatcagctcatcatcaacccaacaggctggaagcccagcatctcacaggcctacctggggattgtgctcatctgggtcattgcctgtgtcctctccctgcccttcctggccaacagcatcctggagaatgtcttccacaagaaccactccaaggctctggagttcctggcggataaggtggtctgtaccgagtcctggccactggctcaccaccgcaccatctacaccaccttcctgctcctcttccagtactgcctcccactgggcttcatcctggtctgttatgcacgcatctaccggcgcctgcagaggcaggggcgcgtgtttcacaagggcacctacagcttgcgagctgggcacatgaagcaggtcaatgtggtgctggtggtgatggtggtggcctttgctgtgctctggctgcctctgcatgtgttcaacagcctggaagactggcaccatgaggccatccccatctgccacgggaacctcatcttcttagtgtgccacttgcttgccatggcctccacctgcgtcaacccattcatctatggctttctcaacaccaacttcaagaaggagatcaaggccctggtgctgacttgccagcagagcgcccccctggaggagtcggagcatctgcccctgtccacagtacatacggaagtctccaaagggtccctgaggctaagtggcaggtccaatcccatttaaccaggtctaggtcttctccctgccatgtcccttgccaggctcttccacttagctaagtgggcacactgcaagctggggtggcaccccagcattcctggctttctggggtccagataggctggcaagagctgtttttgcatccatttgcatcgtgaagactggcattttgatacttcagctgtttgttcctgggagaattctgagcacagattccagaggtcacagtaagccttgcagcttgagctgaaagatgccagagccggagatgtctgctggcagcaggcagggttcattctggtgacacagcaacagatgcctggcctgggaacccagggatttcacctccaccagtgagaccacggggccactgtggggtgagggaaggagcgcttggagtcagagctctagaccttggtcaactcttcacctctgtgagagatggtgtgtggaggtgcttcagaagtaaagaattctaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcaagactccgtctcaaaaaaaaaaaaaaaaaaaaaaaaaaaaaaaaaaaaaaagaattctgtggatgcaaagcagtgggattactgttagatcattagcgcatccagctgaagacaatagatgcagtagtcttggcttacagccctctgcagcaggaattccaggactcacttcctactccatcccttttctctatcactgtgtcttccaccttacatggaaatcagcctgcaagttcctctcctcgatgagatggcaagcgccttgcaggtgaaatccataccatcatggggcttgtgtcttacatgccatggacaggccctggcacaaggagagagctccagggaagttttccatggtgggttgatggtaaaggtgccactcactgctgaatgtttggtgctggacaggagtccagcatgggaagggggccagggctcaggctcctgcagccatagtctcctgcctgcccttccttgcctcccaggacctcatttgatacagtagctggactgagactctgtggctctccccactgttgacccactacagaggcctccagaactcaaggctatggctgcagcctccttcactctgtgctctgaccactgagctgacttgccccagataatgtgccacgtatctttcaaagcttcctcagggtattgggcatcccagtggccttaagtaggatcaggggcagggagtcctgggagtctaacttcatggggcactggctgaaaaaagcaggtgtccccttcctccagccatccagggaaaaaggagaaagggctccaatgagtgtgaatatcttaccttgggggttatggcctagtcctctggatgctgaaccaggcccaaggcttcatctatgtgtggaccagacagcctgtccttacagggaaagaaatgtcaagactgctcctgggctgcattggatgggatgtctccgcatggttctgttggctcagactgaccctccagcagagtggacagtggctggcctactatagcctcccagggcagggtattcatgtgctagagccctggaagagcctcatcataagccagcataggttctgcaaagggggtctggcatagggctctcacccctgaccaagaaccggtggaactgacgcccaagacaagtgctctttgagccagcagctcccttcctggagctgtttgtcttatcgcttcttttggtcacatctcccattcagttcctttgttcatttttgtgttggattttgggcagatttcttgagccattctcttggacacagcttgtgcttgtcctgtggtgccatctgctgctggctgctccaggtgaccacctgccagcgaagcccaggctccgggacccatctattttgtgaaaagcccacatgcacaaagcaacccccaaatgccaaaggagccaagagaccaaagaaggaagcagacaaatccagtttgttggtattgagtgatttattgagggaacttttaagcaggcgggtggtctcgggtggccacaagacaggcagatctctgcactgttactctcggacccaaggcttatataccaagggaaaaggatatacatgctccagcaagacagtgaaaggtagtgtgccagagcaggcaagaacgccatgtgcatcatagcccagaatttgcatgataacatcaagcttgctttgatctaaaagcaggagtacatattcttacactcgggacagtaaataaagtaggagtcaggaggcattcatgggactggggctaatcagaagtcaacatgggaaaattagcatccaagatggagtcacttttgtcttcccatcaccccagaaagatgtcattgttcaagcttcccaaagaattgggggcctcaggccccccctggatcccacgcaagtgcctggagttgcttctcattattagtctcgatggtgccaagatgctggggacaaagatgatttcaggtgcagacatgcttgaggatggagggccaggctaggcctctggggaaagtgtttggtgctaagaattggggtagtgggtagaagcctcgttgagtgtgttctgtgccccagcatcacctggagcttgtagatattcagagtccttgttgccagcccagctcgattgaatccaaatccatgttttatcaggatcccaggttaattgtgtgcacattaaagtttgagaagctctgctctaagaaacaggttgccctggagcctagagacactgggtaagcacctgtagacacccatcctagttctgggaacgtctctaaaattgttattgctgaaaaggtgcattcagttttggttgtctgtctcatctctggctgcatgtggtcatattttttgtgaggctttttcattcttttgataaatatttgccatgtgcatagtttgcatagatatgttcttagtgaacatggctttttgtattctgctctatttcacttaaaactgtatcatcaacagtttttcatcttgctggatatcttttttttttttttttttttttgagaaggagtttcactcatgctgcccaggctggagtgcaatggcacgatcttggctcactacagcttctgcctcccggattcaagcaattctcctgcctcagtctcctgtgtaactgggattacaggtgcctgccaccacacccagctattttttttttttttttttgtatttttagtagagatggggtttcactatattggccaggctggtctcgaactcctgacctcaggtgatccgctctgctctgacttccaaagtgctgggattacaggcatgagccaccgtgcccggcctagatatcatttttgatggccgcttacaagtgtacaaactgccccagtgaaagccagtacccctcagtatctctagctcctgggggtggtggggggggtgggagggcatctctagccagcaagtggaccctctgccacccattgtgggaggaacccaccttacagaggaggatcatggctggaattggagactcataccacaaagactgactgggaacccttggaagatgcaaaactttatcacgtcctggctgtgagtgctaaaaccttgcctaatgctagcctttcttttttaaagtattgatgtggcctttttttttccattataaaagtaatcatattcattctgaaagatatacaatatatacaaaaataaaattgaaaaaaggaaattatcaggagttccaccactcagacataatcactgtttacattttggggagtcattttaaaagttttcatatgcatagtcatatacatatgtctgttttttaaaaaaatggttgagagcatagtgtgtccacatgggaacttataaatcatatttaaggattgttttatatcttttttgtttaacctgatataaatttttattcacttgtttattcattaaacaaatatgtcagacactatgttagctgcggggatacagtggttgtaatcagacattgtccctgttctatgcaacttagagtccattgatagatatatcctatgtccttaatatcatctgttgtggcattctgagctgtctctagacctgttgcatagagttttatgatgaacgtctatgcaaagaaccttttctatatttggaattatttccttaggagagatttccagaagtggaattaacaaagggcatggacagttttcaaggctcttgacgtgtgctgcaaagttgatttccaaaaaaggtctggaacaatttcagggcactccctgaagagtgcccatttcaccgtaccctggccactgttggtgatttaccattaaccaaaagactttgacctgtatcgcccagactggagggtgtcccagctcctgcctccaggtccagcaaacactgtgggcactgaccattcaaggctagcctgaccctgtccctctgtgaaacctttgggggttccacaaagcctttagggttgcaggaccacataacttatccaaacagggatacttgagcatgaaaggggccaccatgaataatcaccctgggacaacaggcaaaactaccctgggaaatgggaacatgagatcatcctactatagataaatctgatccctttaacatagcttaaattcaaccctctccaccatctggccccaacttaccttttcagtctctttgcatcctgacatatcacacgatccagtcacagtcggcctgcaattaccaaccatgccttgggtgtcactgtctctgtacatctgctcccgccattccctcctcctgcctccagccaccccaccccccgccagtctgcaatgcgccccctcgcccatctgtgtaggtccaaatcccacccttgcttcaaaacacaaattaaatggtaccattcaatactgctttcattcaacaaacatgtactgactgcttacgatgtgtcaggcacatagagtacaagaccgaaaacatcccacctcctgtggaactttgatttgtgtgtgcaactgtgacaactggtcctaaagatgaacacaaaatgatgtgccagagagtctgccctgttatggttttgaatagacacacccaccaccccacaaggttatgagctctttgagggtaaaatccaagaggctcatcctccacccttgcaaaacctctgacacacccttggatagagcaggcacttaagcatttgccaagtgaagaattaatattaaagaagcttacctattcactccgcaagagttttctaataaccagttctgggttctccatgaatctgagatcaaaggggagcctaaatttccacataccttagagaaacacccccaggtcctaccactgtgactctctgtccaccctgatactggaagaaactgaagtcaccggattcactgattgctgcttcttgtgaggttaagtgactcatccaaggtcacacagctagatagtgactgagccactggaggggtcaggaggtgatacaggaaagaatcagaatgcatgagtggataagtcaccaaaggagtcactggagtggaggggcctggaggggaaggtgaccctgagtgctggaatggccagagaagaacaaacaagctaacagccccaaagacctccattgtccccagatcccattcactgtcatctcctgaagaacatcactctcacaccatcagtgttctctgctcctttttgcacaaaactcctccagagacttgtctagcctctttctctctctttttttttttttttttttgttcttttagagacagggtcttgctctgtcacccaggctggaatgcagtggcacgaacatagctcactgcaactcgaactcctgggctcaagtgatcatctcacctcagcctcttgaatagctagcaccacaggtgcataccaccatgtccagctaattaaaaaattaaatcttttttttttctttttttgatagagactgggtctccctatgttgtccaggctggttttccttttttcttccttttttgtagagatgaggtctctctctgttgcccaggctggtcttgaactcctggcctcaagtgatccttctgtctcggcctcccaaagtgctaggattggcatgggatactgtgcctggccccctgtctaatcctgaagcttccacttcctctcctcttaggtgctcaccagtccattcatatagctcttgccatgttgccaaatcctgtggccagttctcagtcttgtctgatatggtcgtcagctgtattgggtagttggtcactcccttctccttgagactcctgcatgtggctttttcagggcataatggtcatggttctccctgcctcattgggctcttcttccccatctcttttcttggactcttgttgccctgattttgggacactggagcatccccaaggagccctggaggtcctctcattcccctggtgagctcacccagttttctggtgctaaatgccacaaatactctaatgttccccagtgtatctccagtctgaacttctccctgacctccagatttgggtgtccaggcatgctttgtgtttcctagacaccagtcagcatctcaagcttggcacattcaaaagcaaactccagatttgtccctgctacctccttcctcagtgtcctccttttcagaaaagggcaagtcctgcttttcatttgcttgggccacagtctttgggatcacctcctattcacacccctcatccaatctatcggtgagttctgtaagctgtgccttcaaaatgttctcagaatgaccacttctcactgcctccaggctctgccttcaggttcaagccaccgtcctccctacggagatcatggcagaggcctcctttctggcctcattcagccagagtgatccactgacactagtcaggtgcctctacaactttgttcaaccctccagtggctttccatcatactcagggcaaatttcacagtcacagtctgcacctgtgtctgcagatcatccgcccctctctggcctcacttcccactacccttcccctcacccactcctcttcagcagtgcttgcttctctgctatcttttgaacaggctaagacctctcccgcctcaggcctttctacttcctactcttgctgcttggaatgccaccccttgatatcaactttctcccttgctcccttcaccttaagtgaacctttattagaagattaatttcctggctgggcatggtggtttgtgcctgtaatcccagcactttgggaggccaaagcaggcagatcacttgagcccaggaatttgagaccagtctagacaacacagtgaaaccccatctctctctacaaaaattacaaaaatcagctgggcatggtggcacaagcctgtattctgagctacttgggaggctgaggtgggaggattgactaagcacagaaggtcaaggctgcagtgagccatgatcacaccgttgcacaccagcctgggcaacagagtgaaagcctgtctcaaaaaacagaagactaattttttaaccatcctgtaaaaatataaccatcctccctctctcttcccttttctgcccagtttctgccacaggacttagcacattggctggttctttgttgagggtctccactccctcattagaacatgaaccccatggaagtaggcactgtagatgttttatttactgtccagctctcagcaagaacaggctgttcacgagaggtgcagaagaaatatccatagtacaagtgaatttccaactgttatagttcatcagtggagagctgcacttcagcctcttatttgtggagagcgggcatctggttttgtagctgtttggtcccaagtttgacagccgttgtctgctgactgaaagggagctgaagcagctccctttgcatcctggtttcctggtttgtaataataaacactggctgccatgtatttagtgccccaaccactgtgccagatgctttatatacattgccttccctcaatcctgagatcagatagatgaagaaactgaagcttatagaggtgaaataattttttccacattttcaataagagccaaagatgaaacccaatcagttgtcttccaaagcctatgacttagactgttgtagcaggaaggacagttggccagatgacctccaagtggccttgaagctcatagctagaaagtatgagctttatgggcaatggagaagcactgaaagcttttaagcagggggatggcatggtcaggttacatggagggagagtagtgtggctggattggcctgcattccccagaaagcagaagctggggcagaggtctatgagcttttcctttattagggagaaagatcccagggaacaagatgaagaatatggggaaggagacagggaaggagggagagtcaatctgaagatgcgctactgagctggcagctgattactcggtatctcttaaaaccatcttaggacagtttgtctggacgaaaaaagaggtaagaactcatccatcggtttccatattcccttggcaaaggttcgtacatggagcattacctccccacactctggggacacacaggaacactgaacatacctggacataaacagagcaggtcctgcagagatgagaaggatgtttggggtgtgaggtgaggcgccatcaggtcgcacctgtgtgaagccagtgagctctctcagagctggtgcctcagtgggtgctggaccaagaggccagtgaggacaagaggatcataagcagagcagaaacagcatccaattcagggtcagaggaggtggtgtgggctgaactgtgtccccccaaactcatatattgaattcctaaccaacggtacctcatcatgtggccttctttggaagcagtgtcattgcaggtataattagttaagatgaggtcatactggaatatagtgggtccctaatccaatcccttggcaaaggttcatacattgagcattgtccgtataagactggtgtccttataagaaggggaaatttggacacagaaacacacacagggaggatgtgttgtgaccatgaaggcagagttcagggtagtccttctacaagccaaggcatgctgaagatggaagtaatccactagaagctgagggacaggcacccaacaggctcctgcacagccttccgaaggaaccaaccctgctgacaccttgaccttgaacttgcagcctccagaactgtgagaccataagtttctgtcgttttagccgctctgcctgtaacgctttgttgtggcaaccccaggaaactaacagaggaggtgagattgggggcagggaggcccatctgtggggggcatcatgtcagtcaggcactcagtaactgggggaaaatcccaaactcaagtgggtgatggcaaaatggggaaattatcggctcatggaatggggctctccaaaggaagttctttgacttcaggcttgattcaagggtttgaacgaggatggtagggctctctagtccttgcccccttgtctccacatgttttgaactgcacgtttgtgtgcctccagaattcctatgttgaaaccctaacccacaatgggatggtatgtggagatggagcctttgagaagtgattagatttagttgaagttatggggattcttcatgacgggattaggcccttaccagaagagaccaaagagcatgctctctctctctctctctctctttctctgtctttctgtctctctctctctctctctctctgccatgtgaagatacatcagggagatgtccatctgcaacccaggaagagagccctcacgaggaaacaagcaggccagtaccccagtctgtaggacttcccagcctccagaacagtgagaaataaatttctgtggtttataagccacccagcttaaggcattttgtcacagcagccagaacagaccaagagaggtgcctgtgtcttgatctctagagagagcattggccaaggccaacccagccatgagagagagacagagagaggcagggctgggctgtggctggctggggtgtggactgatccagagctggcagtgggccagaggaagttcagctccccagggctggatctggtgagaggacatggaggtcagcaaacaagttagggtcctgaggcaccgggtgggggtggggttcagcaaggaggtcttggtggacaggatgtggcagtggcagaggagctagttctccagagctgagaccagagatgataccaggtaagtggcccttcacctgtgctctgtggcctcacttctgtagagaatcgaggccagcttcagggtcaagcttctcggctggaagctgggagttgttgctgtggttcactgagtggcagggatacagtgatgactgagaaaatgctgaagagacctggaagtcccccatagaagaaatctgattcttacagcgctgcggagaggcagtctgggaaggcctttcttcccagagtatctcttcaaggttctgatacacctcacaagccctgcaaatacagacagaccggaatggggctcccaggtccagaggagatattgggaaagggtccgaggagcagagcaagatgtctgcttagccggcagtagccagcactcccggcctgggcagccaaacaggcatctgcaaggggacttgacaatgatcggtggagcaggagggtgcttgagagtgtggctgcttaatcatggccttgaggtttgttgttgtttaaatgtcaccacttatttgaaactaattcctgtcagactgcgaaaagtttatcagtgtaattgggtgccggcaaaaagctctcttaaaatacacatcctttcattcataaagctatcaatggggcatttgattagcatctttttgactgccaaggaaaccatactgaaagcagggcatgcattcagaacaaagaactccagctcgtgggtgaaaactctgcgatagccatatctcccccaccagatagtgtgctttgtgatggctggcagcctgtgccccttggaaatgtcattttcagccccttctgggcttgtgactaaggtgtgggtggtggatctacaaaggatttcccaaaaagaaggcctcctttacataccttttgttctgtggactgacccacttgtcccacccacatacctgcagcaggcgggagagttgtgccttaactgggcagctgtgagcaccagtttttttccccaaattcctgggtgctatctgagcatgctgctatttggcagtggggcctcagtcacatcctgatggagaaaatgtgaaggtttgtcatcagcttatttaacaattcagaggctggagtctattccactttttgtccagtatgtagctttaaaacagttacatataacatggaacagtatgacatgaaaagagagaggtttatagagggagatgggaatcgtgacagcccctgcttacggagtttgcccctccagtcctgaattcttctgcatccccacatcctgcttgtctggaaaacggctgcagcttactacttcgattcttggccttccagaaactggactcctggcccatcttttcatctctttggagaaacaaacaacaaacaataatctcgtcataattaaaattcactgtgatataaagctactctaaaaatagtacaattaaaattaaaatttatttcatttcttgagctgacatttcagacagccaggggcctcccactaaacttgaaggtgatgagtctctgctcagtctcacctcccgggcttctgttccagcatgagtctgagctccattcaactcttcccgggccttttcagctctaggtgtaaaggttcagtgtgaactcgtagaaagaagacaggcttttcagtcaacagatctgaattcttacacgcactgtctcatagtccttggtctcagtttccatgtttgtacagtgaggatcatgggttccaaggatttgggttccaaggtggggttggacaatgaaaccatagctgtccagtgtggtggccatgggccacatgtgacttctgagcacgtgaaatagaactggcacaaattgagatgtgccaagtgtaaattacacattgaatttcaaagacagcccctacaaagaatgtgaagtgtctcattaataattttgtatattgattatatgttgaaatagcaatattttagatatattgggttaaagtatgaaaatcaacatcaatcttttcgttttactctcactattttttagagcagctttatagtcacagtgaaatggagtagaaagaacccaaatgaccactccatctgtcctaagccagtctgagggctttctgtccagccctaacgctgtaccatgatcctcactgtacaaatatggaaactgagaccaaggactatgagacagtccttataagaattcagatctgttgactgaaaagcctgtcttctttctacgagttcacactgaacctttacacctagagctgaaaaggcccaggaagagttgaatggagctcagactcacactggaacagaagtccaggaggtgagactgagcagagactcattaccttcgagtttagtgggaggccactgggctgtctgaaatgtcagctcaagaaatgaaataaattttaattttaattgtactatttttagagtagctttatatcacagtgaattttaattatgacgagattattgtttgttgtttgtttctccaaagagatgaaaagatgggccaggagtccagtttctggaaggccaagaaggacttcccgtatccttcctgggccccaaacatgcacagcctccccgttagctacactgtccactagagtggtgtgtttgttacagttgatgccagactccatggttcggggtttgctcttggtgttgtacattctatggatttggacaaatgcatcatgacacgtaaccaccattatagtatcacacagaatagtttcatggccctaaaaatcctccgtgtcttacctatttatcacctcctttcctgttaaaccctggcaaccaccgatctttttaccatccccgtagttttgccttttccggaaagccatgtagttggaataatactgtaagttgtctttcatattggcttttttcacttaataataagcatttaaagttcctccatttcttttcatggcttgacagctcatttctttttagagctgagtgatattccattgtctggatgtgccaaaatttatttatccactcacctactcgaggacatcttggttgcttccaagttttggcaatgatgaataaagctactgctgtaaacatccatgtgcaggtttttatgtgaacataagctttcaactcctttgggtaaatatcaaggagtacttttgctggattgtatggcaatggtgtgtttagttttgtaagccactgccaaacttcagccgattcctggtttccctattctcggcaggctggcctcacaaagttcgtctcctgcagagctccaaggaagctggttttggctgaatctgaagatgatcaacactggtaggatgctgctgtgtcatagactggaaccccagctcctgatcatgctggagtggggctgctgctccctgcaaccccacctgcctcccccttgagctggaagagaagggctgacggccagagttctgccataccccactacgatcagatcaagctctgatcccaccaggccaggggctgtgcttccttgatcatataagcccaaggtccggggtcgctctcctggagtctgacatcagcccggctaggtcccagtgcgctgctctggaagggtcagaacgcttgttcctgagcttatctctgtggattttccctgatgaactctgatctagcaggcagtgtatgggctgctaagtacttttcccttgtttgctcaaggagtttgcggccccaagatcatttccaaagccttttgcttcagcttgctaaagggaagctgctgtcactctcttcagcttgctaaagggaggcggagttctgaggaaggcaggcaccttaagggatgttgaaagttgcctctgtttgctgtgcctaccacctacttctagtcctcctctcgccgcccagatcatcccctacaatgcattacccatgcctgccccccaccacccagaagctatgggggctctggtccaagccccacacttgtccgaaagaggtgcctgggccccacagaagccttgtcagatgatggcagctctcttctgatagttcaatggatctgccacctacacagagaggtctggaagtcgctaactctctttgagtctcagattccatagtagtcaaatgaagggtttgaaccagaatattttcaagaatttgtgctcttctaagagtccatggtttttttaaaagttaatttaagttttaaaatttattttttattttatttaaacatttttatttattttttaaaatcttttattttaggtttcagggtacatgtgcaggtttgttacataggtaaacttgtgtcatggggatttgttgcacagattatttaatcactcaggtactgagcctagtacccaacagttatttttctgatcctctccctcatcctactctccatactcaagtaggccccagtgtctgtcattcccctctttctgcccatgggctctcatcatttagctcccacttataagtgagaacatgtggtattttgttttctgttcctgtgctaatttgctaaggataatggcctccagctctagcctacactatggaatactatgcagccataaaaaagaacgagatcatgttcctgtaaaggacatgatctcattcttttttatggctgcatagtattccatagtgtatatgtaccacatcttctttatccaatctaccattgatgggcatttaggttgattccatgtctttgctattgtgaatagtgatgcaatgaacatgtgcatgcatgtgtctttatggtagaacgatttatattcctttgcgtatatacccagtagtgggatttctgggttgaatggtagttccgtttttaggtctttgggggaattacctcactgttttccacaatgattgaattaatttacactcccatcaacagtgtataagcattcctttttctctacaaccttaccagcatctgttattttttgagtctatgatttatctttgtgggaaatagagtaattttaaggccctccaacctctccatggaatgaagtagagatctgccagcaaagccagcatcaggaccgagtagaatatccagtacatggcaggtgctgcgtgatttttgttaaaatcataatctcattttaagaggactgtcctacacaggccaagcttgattccatggctcttccagttaatttcctcatctaagttagtattagccatgtccacatctgagctgtgctattaaaagccagaccagcagcctcattgctcccatcgacaggcatatggtactagataaaaagccataaatgtccaaactgttgagaaaaaatgtgagatgagttgagggggacacaggttgccagcctgccactctgggccccgtgctggcctgggtgcagccctgtgtcctgtgttgctgacctgtctcccagtgtcaggcttgggcctccctaggaaaattttccatggggctctgggcctcctcctccctcctgccttgcctgaactggccccacactcaggactggggagtgtcaaagtgtctgagcctgggggaaggaacaaatgcaaagcacgtgaggattcctcctctggggagagtttatcccataagtaatgacatcacggttccccagccttccaggatggcatcctcaaggtcatcttcatcctctcttcctctacaggctctgccactgcagctacaaactgcagcgaaggcccccattaggaaaaatactccccacgactttgccagcccctgttctggaccttcttcccctcagagccaagccccacaagagtgttctacactcctggccaccacactctcactttctctttgcttctcagctgacaggcattttcacttctgtgactgctgaagctgctctgcataaaagcccatctctactaaagataaaaaattagctgaatgtgatggtggacaactgtaatcccagctacttgagaggctgaggcaggagaatcacttgaacccaggaggcggaggttgcagtgagccgagatcgcaccattgcactccagcctgggcactaagagcaaaactctgtctcaaaaaaaaaaaaaaaaaagcacaagtggcatggtcttgccatgcgatttgggtccttgcaatacttgatctttgcagcttcattcttgacatcacctccctgaaatctcctcttcccttagctcccatggcctgactccagctaggtcctctgtccctcatatgccaggctttcctggttctgctgtagcttttgtgtcctgcccccaacaccctccataagcaattgcaactgtgccccgttcccagactcacaccttctccagtctccgtctacctgcaggctggacgcctccacggcgtgttccacacatacctcaagtgcaagtccaaagcaaaatatggtccttctcagattccagctggattttccatcacagttattcctattgtgaaccactgaattgcctagttaggggcatctgattcagacttgttcctttagcttggactatgtcaagaacctccctcaatgacatctctgccaccaggccttttgtccagcgatcctttctctggacaacgtctcacatctgaccttgactctcccactcagcggttcctgccctctgcaggatggggtccccgtgctttcacatggcccctggccattcacagcttccccctggctggccttcctctcctgcttgttccagcaccccctcactcccaccccatgcttgaatccacagactccttatttttgggtcctcacatatgccacactgtgcccagctcaatgccttccgaatctcatgctttccaattccaagtttaccttctctgaaaacttttcctggctcccttgtttcgtgtctgcatccctggattttgcactttgccttgttcctgttgggcacttagggaatcttagagctggaaggatgcaatagagtctccatcttttcacctggctgtaaccccggcaaacaaagggtgtaggttgttatctcctgggcagctggcacagtgcctggcccagaataatgccccctgagagcacagtaaattggtttccaccgtgaagaacagatattggagcttgaaggtgagctagcctccaacaggggaccagggaggtgctaggccagcgagcccaccttccccacgatgcagccaatcaagactccagagggctccagcaacagcatgaaaaaaatagctctccatacaaagcatggaaactagactttagggcctaggggaatggggcttgtctgcctctatgtaagaaagcaggacaggccgggcatggtggctcacacctgtaatcccagcactttgggaggccgaggagggtggatcatgaggtcaggagttcaagacctgcctggccaacatggtgaaacaccgtctctactacaaatacaaaaaattagccaggcgtggtggtgggcgtctgtaatcccagctactcgggaagctgaggcagagaaatgcttgaatttggagggaggaggttgcagtgagccgagatcatgccactgcactccagcttaggcgacagagcgagattccatctcaaaaaaaaaaaaaaagaaaagaaagcaggacagtatattgcaaattaagctcaataaaaagagagaaagagagggagagagagagaaagagggagggaggaagggagggatagtgagaaggaaaggggcagtcaggcagaccatggtcccctgccaattctctgggcaccggtggaagcaagttctgcgtcttgggcacagtactttatcacctgattgtacttcctccacctctccccaggcagaactattgacccagggatctataacatttgtatatatcaacacagaaaccaattaacaaatgcttatattcctgtgcaaatatgcaaacttccttctgcagacaggggtaagcagacacctggcagtatttttagaaatatttaagaaacacagttcaggtaagaagcaggctgctgtaccctcctccgggaggaccagtacctagaaccatctgtttttctttgtcttccctgctctgctctgagcgtggggatggtccttatccttagcttcatctttattaaagctggcattttcggctgggcatggtggctcacgtctgtaatcccagcactttgggaggccaaggtagatggatcacttgaggtcaggagtttgagatcagcctggccaacatggtgaaaccccgtctctgctaaaaatacaaaaattagccaggcgtggtggcatgtgcctcgagtcccagcactcgggaggctgaggcaccaggattgcttgaaccctctgcagtcagccaagattgcgtcacggcactccagcctgggggacagagactctgtctcaaaaaaaggaaaaaaaaacagctggaattttcttcagtgcttacgctgtgccagatacatgcatttactcacttcacaatgagagggaagccactatgtttatcagtgaagcagggtcatttgggaagcattatccaacaccacctactatgggcccagcccatggcaactggaagcagcactactcagaaggaaaggcatgtggagaagctcagagctgacaggggagtctatacttgattgtaagatttctgtacaaaatgcctttctgtgtgctgtatcatgtagtgaaagataagaaacaatagaatgtccagcaatcagagaaggcttgacatgacaggctactttttaacagcactgagaaaagcttgctatctattaaatattttaaaatcaggtgctaagccgcagagtaagcacctcattatttggaaatgcacttatacattcacagaagcaacacccctggaaggaaataccccagtgatcatgggattgtagtaacatttttgtttgtactttttatataccttaaatttaaaattccttatgaataggtgaaaagcctgtccaggaagctttgtagggtcccctgagttcttggtgttctgtcagtggaggctggtttgagtcattcctgtaggagagctacccaaaacaaaacgaaggggaagcaagagatgcaagcttctaagcctctgacaccttttgcaaaattgctttcctgcaaggctgtgctgcttcacctgctcccccaccagctggtgtgagaggcacagggtttggagcagacagctgtgttctgaagggatggcattctgtctggtgacacttagtggcagtccacttttctcccacaggttgctggctgatctagttgccaaggctcctgcgtaggtgttatctccaaacatgcaggcatagttaagagatgagaaatacacgtgtttggacaaaagactggagcacagttcaatcagcctcagcaacattatctctaaaagcaaatgagtcctgctgttgctggggacctacccctctgccttggctggaagtgtttgagtctgtctgaacggtctgttatctccagggcaacataaagtttgcaggaggcctgttcactccaggtgttatcgctgtcgctgagatggtgctaagcctacaggcggcagaaggccaattgctaaggcagagggagcctttagtggggagccaggcagcctggggaccctgggccacagcttccttccctatgacatgcactctcatgcccttcccactcaaacatccagtcattctgcacgtcctggtagagggagatgccaggcgaaccctcggggtaaccccagcacctggaaaaactcctcagtgggtttgctcagtgtcatttaaggatcccaaccttgaaggttttggacttgggatcacacattgtttcattcagagtgttaggataggggtctgtctagttcaggcatctcaagttagagatgagaaaccagactcagaagtctgacggtccttggaggctggccgagagaaagacctgaggctccccgtctccctgcctgggcacctcataccaccttgcttttccctgccccatgtcaagagcaagctggagccgaatttggggctcccagttgggctccaagtgtgatttcctccacacttgatgaccaggaggccatttgtaggaggctgggatgagcaaagtgggtcaaagtgccccctgcctccaaatgctcgcgtggaggttgggcagtcagacaccatgggggagaaaccccaggactttagcagaacaaaagaagggcaccctcccttcctgggccctgccagactcttggcagaaggccagggctactcatggggcggggagtgggggaaggagggaggagcagggatggtctgttccagccctcctgtgttcatcctgagccgagtcactgaggcctgcagcacagctatgacacaacttttggggtgtcctggtaggagggctttgggctgcaggtggggcattggaagcagatttctctctatagtaaggcagtagatccccaggccttgccctctgttcctgaaaatgtgagttgtaccttgaaccacaaaatggctgtggggtgcagcttggtgtgttggaaggagggctttggatgtgggctgcaactgcatcatccttgctcagttctcatgtggcaggtgtgctcctgcctggtctggggcagtctggcaggctgctctgtagccccaagcctggatctgccaaaactggcaaggagtggaggcctccccgtggagcagtgcctgaacctgcagcccctggggcagacactcctggctcctgggcacctcactcaccatggctccccactttcttagttggctcgggccgctattgcagaatgccatacaccacgtggcacgtggacaacataagtttatttcttacagttctggaggctgggaagtccaggatcaagtagctgaaacagatttggtttctggtgagggcctcttactctttcatagatggcgccttcttgctgtgtcctcctatggcagaaggggtgagggatctctccagggtcttttataagggacctaatcacccctgcacaacccagcctcctaatagcatcaccttgaggtttaggatttcagcacatgcactttgggtaaacaccgtcaatctagagcatcctccccccccatcatgctggcttccagactctgctcccaagtgaatgtccacacccaaggggggccctgagtcttccttaagtctctttgtctaggacagactgtgctgaaagggcccatctaatctcctgatatggtttggctgtgtctccatccaaatgtcatcttgaatgatagctcccataattcccacgtgtcgtgggaggggcctggtgggaagtaattgtatcatgggggcaggtctttcccatactgttctcgtgatgctgaataagtctcatgagatctgatgattttataaagagaagttcccctgcacatgctctcttttgcctgccaccatgtaggatgtgactttgctcctcattcaccttccaccatgattgagaggcctctccagccatgtggaactgtgagacgattaaacctttttcttttacccagtcttggatatgtctttattagcagtgtgagaatgagctaatacatctcccaacagcctgggccccacccacccccactcctcaaacctcctcagtctgtccttgtacaggttccttctcctccagccccatctcgcttcatgtgacttctttcttccttaaactctctgcactctctcctgctcccaggattttgtatctgcagtttcctctgcctggaatgtactccacctggtctacaactcccagctagcctggagtggagagcttctatgtcactccctctgggatgctcctgctgacccccaagactggctcaggccctgagttcgaccctcttgtggttcagagaattcctgggcatagccatgccctcacttgtgcttccactgccacatggggttgctggactgttgtccacttcctcaggggcatctgcttcctcagaacagggcctgggcattttgtcacctaggattccagtgccagcacagagagtgggctcagctgcagacactcagcaatgttgactgaatcaggaggcagcaggtgactcgatgttatgggctcacgggaaaacccctctcctcttcagagggccttaccctgaggtggcctcaccccagttgtcttcactgggtatgggtctctttgcccacccgctgctgcctcactaaccttcctggcctcagacaaatctaaactcaagtcaaaaccagggtgaagatgggcctacgtcagctccagagagggacagcctgaattcccctccctctggtcccatttccttgggaggatcagcctcttcctggatgatgacaccagggctcttcaccccctagggaggggtccagcccatgtctgtggctctggtctgggccctgaggggacacacagtaagtggcaaacacagacggaccaggccgagagcaagacaacatcctcaatggttaagatgtataggccagagggaaattgatcaggaaatgaacttagaagtatccagggactgatggggaaggagctgtatttggaggacctgtgatgcaagttacagaatcaaagatgtggcccctggttttgctgtgtcctcctggaatgggtagcaggacaggagccaccatgcagagggtggtcacacactcgggcttgctttaacctgggtctttccttaccaatgcatttctggctacactggggaaaacgaggtggctaacacattttttttaggtgttagaagacctgtgtgcactttctctctttctccctgcactccagccacactggcctttgagtttgtagaatgcctacactctgctctgcctcagggcctttgcatgtactgtgctcactttatggaaagctttgttctcaatctcatccaatctctttaattatttgaatgctatccatccttcaacattcagttcaaatatcatagccagtaaaatctgctgtaataaactctcttagtttcctccaatttttcttcctaatatttatctcagtttgtagtcatgtattcttgcgatggttgggctaatatctgcctcctcactggtgtttaacctctagtaaacactagaggtttaatctctgaggtcacatctctgagggcagagatatgagtgacaggtccagtcttattcccaacatcaaggccagagcctgtcaggcagcaaatgcttagtaagcatttgttgagttgactttgaattgtcagagctagagggtcggtttagcattgacacatgggggacatcatgggagaagccacgttttgttaggacctggccctggggagatttcttaagccaaaggctttgggtctgccacccttccatccaaggagaagtctgaagacagggtcagcattttgtttgtcctccacagttgctaactttttttttattttttgagacagagtctccctttttcacctaggctggagtgcagtggcatgacttcagctcactgcaacctccgcctcccgggttcaggcaattctcctgcctcagccttccgagtagctgagattacaggcatgtgccaccaagcccagctaatttttgtatttttagtagagacagggtttcaccatattggccaggttggtcttgaactcctgaccttgtgatccaccctcctcggcttcccaaagtgctgggataacgggcgtgagccaccgagcctggcccacagttgctaacttttaacacacaggacatttcatgtaaaaattgtgacttgcagcttcttttgaagaatctgaagtcaagcagccctggcctgcatttgtgcatggctacctttgtgggatcttggtcacagctgaccctttgggtgggcatgctactcttcagttagttgggccctcttcactagttttttcactagtttttagcacctgcttgcccctgttagcaggtatggacttttacctgaacactcagattagaaagagatggaaaaaccacatggccttgcagaataagggagatctcatctccatgcaatgaggaatcagtggcaggcctctttgcagaacctccctggaagggaattgctatggttgcatgtgtcccacaaagtttatgtgttggaaacttaatccccaatgcagcagttttgagaggagggagtaatgtacagaaaaatatccagaaatctgtacagttgatatggcttggctctatgtccctacccaaatctcctgttgaattgtggtctttagtgttggaggagaggcctggggggagatgattggatcataggggcagatttcccccttgctgttcttgtgatagtgagtgagttctcatgagattatcactccccctcctgctccaccatgtgaaggatgtgtttgctttctcttccccttcttccatgattttaagttttctgaggcttccccaaccatgcttcctgtacagcctgtggaactgtgagtcaactaaacctctttaactcataaattacccagtctcaggtcattctttatagcagtgtgagaacagattaatacaacagggttccccatggatctgttataaaaattaggttgtggatgtctatcataaaactccaggaggctgggcaaagggtgattggaaagcagtgagcaggcactttcagagctcatgtgggacatggggggactcctgcattcctaccagccagagtggagcgtccttgtagaaaatctggtgcgttcagttgacatcccagaaaagtcatgtcttggcaggaggagtaaagaagccctaaataaagtctaatctaacccctttccttcagtcaaagcttcaaaacaaacctcaaaagggtcagggtaatttctaagtaactcagctggctgccagaaaaatatctaccaatctttagaggaggacaacaaaatctagcattaagtaaggtataattaacaatgttcggtgtcatataagaaatacagacatgtaaaaatgcacagaagtgcaactcctaccaagagaaaaaccagtcaatagaaacacactcaggaatgatggatgttggaaatagcacacaaaggattgaaaacaccaattacagatatacacacgaatttaaaggaaacatgaaagtaatcatcaaagaaggagaaaaattaaaaaggaaatacaagggccaaaaataaaaatcttaaataaaaaaatttctttatgaaatgaacagattagacgtgaagaagaaaagatcagtgaacttgaaagttgcaatagaaactttcaaaactaaaattcagtcaaaagagactaaaaagaaaatttaaatgaatctttagtaacctgtgggaaaatattcatgcaagtatatggatcacatacttgtaattggaagctgagaaggaaaggaaagagggaagagaaaaaatatttgaataatggtaaaaaatgctccaaatttgatgaaacatacaaaaccacccatccatgatgctcaatagatcaaaagcaagataagcacaaagaaaactatgcaaggtaaaacataatccaattgctaaatgccagtggctaagaaatgtgggtgggcttcatcaaatctattgaagatctgaatagaacagacagactgactctcctgcaagtaagagagaatttcatcctgcctgactgctttgagctgggaggtggttttttttttttcctgccatttttgaactgaagtatcagctttttatgagtcttgagcctgccagcctttgaactggaagtacaccattggctctgctgtttccagcttactaactgcagattttgggacttgtcagcctcaataatcataggagccaattccttacacacacacacacacacacacacacacgttatgcatatgtacaaaattatatatagttatatattatatttaagtataatcatatctatctattccaaaattgggtctctaatctgattacattttaagttgctaataactttatttccaactgtaaagagagcactaatagtccatggcatgatctaacaataaagatatcaccactggatactcctaatcaaccccttataagagacaaggagctgggtaactgtgtatactttcaattattttcctcacactaacaaatataataagactcaccaggtgtttctaatgtgaagtgatactaagtggacaaaggatgaaaaacacttaatggtaagtatgtgggtaaatacaaaggcttttctcatttttaaatttccttaaaagataattgattgtttaaacaaaaataataacaacgtactgtgtggcttataacctattaaagcaaaatatgtaatgatagcatgatggacagaatggaggaaatggaagtatatggttgtaaggtcttacattgtacataaagtgttataatagtatatttgtaatgagctaatgatacatattgtataccctcatgcaaccactaaacatgaagccagagttatagctaatgaactcacagtggagataaaatagaaccataaacatttttaattcctctaaaagaaatcaagaaaagagaaataaaggatgaagaacagatgaaataaacagagaacaaatgacaaatggtagatttatacccaactatactgataattatataaaatgaaactggtctaaaaattccaataaaaagacaaatatttttagactgtataataaggcaagactcaactctatgttgtctgaagacctcaataatttaaaggcacaggtaggtcaaaagtaagaggatggaaaaaaatatactatgtagcaccaattataacaaagttggaggggctagttaaatatcagaaaaagtaaacttcagaacaagaaatatgcagaacaagaaataaacgagaacatttcataatgataaatttatcagaaagagaaaaattgtaaacatatattcacctaataatagaacttcaaaatatgacaaagaaatggacagaaatgaagggggaagtagagaaatctacacttatatttacaaattgtcatacttgtttctcagtaacttatagaacaagtagaaaaaatgaataaaggggaaggacacttgaacaatactactaaccaacttgatttaattgatgcctatagaaccttctacctaaatacagatttttaggtgtagtgttttatatcctaggaatgcaaagtcagtttaatcaacagcgcaataaatcaatcaatgcaattcagcatattcgtagaatccacattgtttccaactgaacacaaaactttcattataatggaccatatctggggcagaaaacaagtttatacatttaagaggaccaaaataatatagaacatgttatctaaattcagtggaactaaaatagaagttaatagcagaaggatatctagaaaatccccaagtatttggaaactgagcaacatacttttaaataatacatggatcaaagagaaaatcacaaaagatattttaaaataatttttcctaaataagaattagaacacagactatcaaaatttttgtaatgattagagacaaatttataactttaaatgatttttattagaaaatataaaaagtccaaggtcaatgatttaagctttacttttagaagttggaaaaagaggagccaattaaacctaatgtaagtagaagaaaggaaatcaagttaatagcagaaaacaatgtaatagaaaacggaataataaagaaagtcaataagataaaaagttctttgaaaagatcaataaaattgataaactcctaataaaaagtcataaaacaaactaccaacatcactaataaaagagggaataaaaattacagactatgtagagattaaagaaataatatggggatattatagaagctttacggcaacaaatttgacaacccagaggaaatgggaaaatttttcaaaagaaaaattactaaagcccagtgaagaaaaaatagataacctgaatagctttataaccattaaagaaattaactttgtaattaaaaactttcacacaaggaaaattccaggctccagtgacttctctagtgaattcaatcaaatatttaaggaagtagtagtatcacttttatacaaacttgcagaaagtaaaggaggaggaaagactttctaacttaatttatgggatcagcataatcctgatatcaaactcagagaaaagatactacaagaaaaaaatcttataggccaatgtccacaaggaatatacatgcagctgggcaccatgctcacgcctgtaatcccagcactttgagaggctgaggtgggtggatcacttgaggccaggagttcaagaccagcctgggcaacatggtgaaaccccatctctactaaaaatacaaaaaattagctgggtgtggtggtgtacgcatgtaatccccgctattcaggaagctgaggcaggagaatcacttgaacctgggaagtggaggttgcagtgagctgagatcgtaccactgtactccaggctgggagacagagcaagactctgtctccaaaaaaaaaaaaaaaaaaggaatatacatgcaaacatccttaaaatatttcagtatgttgaatctaggaatatatgtagagggtaatacactatgaccaagagtgcttatcctagaaatgcaaagttaatcagtgcaattgaccaatcaatgaatgcaattctagcagtttaaagcagaaaacccaggtgatgatctagatagatgttataaaagcatttgacaatatgcaatactcattcacgatgtactttttttaaaaaaaataaaatcctcttaaaacactggagtagaagggaaactcatcaacctgaaaaaatgctgtcatgaaaaacctacaggtattatcaaatttgatagtgaaagtcataacgttttcctcctcaggttgggagtgaggcaggaatgtccacttttgccatgatcattcaacactgtaccaaaagtcctaggtggtgcaataatgtaagaggaaataccgacataagattcgaaaggaggaggtaaaactgaatccattcatagaagaaataataatgtacttgaaaatcctaaggaatttacaaaaagttactaaaataagcgaatttagcaaggtcataagatacaatggtcaataaacaaaagatcagttgttttcctaaattgtggcaatttggaagattaaattatataaataatactgtctatagtaccatttgaaaatacttacaagatgagcaaaatctctatgtaaaaaactatgaaacattgtggagacaaagtgaattgccaatattgttaagaagtcagctctcctgatttttggttgaaattgacaaagcgattccaaaatctacatggaagtacaaataatctagaataatcaaagcaatttttacaaagaatgaatgttgaggacttatctactttatttcaacattacaggaaagccagtaatgaagacatgtggtataggtttcagtttagacaattcatcagtggaacagaatcagatgtcctgtttctggacatacataatatgttgattcctaacaaagttaccaaagtaatttgatggggaaaaagatagtctttgaataaatggtgctaaaacaagtgaagatctatacatgaaaaaagtgaacttcaacccttacctataccataacttgaaatgtatcacagacaaaaataaaagctaaatttgtaaagcttctagagaaaaacataagagaaaatcttcacaacttgggcaggcaaagatttctcagggcacataaaatttttgaggaaaaaaattgataaatgggccttattgaaattaaaagtttttggtctacaaaagacaccatgaagaaaatgaaagggcaagttgcagaccaggagaaaatatacacaggtatttggcaaagtaatggtatgcaaaaattaaaaagaaccctggaagattagtaagaagaagacaaaacaactttatcaaaatgggcagaaaattttgagcaaacacttcccgaaacaaccaataaacacataaaaagatgcactgcagcattacacatcagggaaatgtgacgacccctcacaccatgaggatgcctgaacttaaagatcgacaattctgaatttttgtaagaatcaggagcaactggaactcttgtacaatgttagtggaaattcaggattaatgctgtcacttcgaaaaacagtttggaagtttcttatgaatttaaatatatacttaccatacaaaccagaaatttccacatcaagttaaaaagctgcacagcaaaggaaatgacaaagtgaagagacagcctacagaatgggagaaaatatttgcaaactacccatctgatcaataaccagaatctatgcaaagctcaaacaactaaataggaagaaatctaataatataattaaaaatgggtaaaatatctgaatagacgcttctcaaaagaggtcatacaaatgaaacataggcatatgaaaaggtgctcaacatcattgactgtcagagatatgcaaatcaaaactacaatgggatctcatgtcaacccggttaaagtggcttttatccaagaaaggcaataacaaatgttggtgaggatgtggagaaaagtgaacccttatacactgttggtgggaatgtaaattaatacagccactaggatgaacaatatggaggttccccaaacaactgaaaatagaactaccctatgatccagcaatcctactggtaggtaaatacccaaaagaaaggaaattagtatatcaaagagatagctgcacttccatgtttattgcaacactattcacaatagccaagatttgaaatcactctaattgttcaccaatagacaaatggataaagaaactgtggtacatatatacgatggagtacgattcagccataaaaaagaataagatcctgtcatttacaacaacatggatggaattagaggacataatgttaaatgaaataaaaaaggcacagaaacacaaattttgcatgttcttactcatttgtgggagctaaaaattaaaaatattgaactcatggagatagagagtggaatgatggtcaccagagctgggaaaaggttgtgggtgtggggggtgggaaatggagatggttaatgggtacaaaagtagagttaaatacaatgaataagatgcagtatttgatagcacaacaggttggccagtcaacgataatttttagtatatttaaaaataagtaaacgtgtataattggaatttttgtatcacaaagaaatgataaatgcttgaggtgatggataccttgtttaccctgatgtgattattacgcattgcatgcctgtatcaaaacacctcatgtactccataaatatatacacctactatgtgcccataaaaataaaaaaaaaaacagaaattcctctcctaggtatttatttattcaagaggaataaaaacacctgtgttcacaaggacttataaacaaatatttataacaattttagtagcctcaaactggggaaaaaccccagacagtagaatggataagcaaattgtgatattgctgcagaatggaacactacccaacattaaagcaggagagattacagatacacatgacaaggagaatggagctcagaaacattatgatgagtgaaaggagcccacacaagagactacagtcatggtggtatagtttggctgtgtccccacccaaatctcatcttgaattcccgtgtgttgtgggagggacccagtggagggtaatggaatcatgggggcagatctttactgtgctgttctcatgatagtgaataaacctcatgagatgtgatggtattataagggggagttcccttgcacaagctctctctttgcctgctgctaaccatgtaagacgcgacttgctcctccttgcctcccgccgtgattgtgaggcctccccagccacctggaactgtaagtccattaaatctttttttttttttgtaaattgcccagtcttgggtatgtctctatcagcagcttgaaaatggattaatacacaacgatgctcaatgacagtgatgcgttctcagaaacacatcattaggggattttgtcattgtgtgaacatcatagagtgtacttacacaaacctaaatggtacagcccattacatacctgggctctatggcatagcctgttgctcctaggctaccaatctgtgcagcatgtgactgtactgaatactgcaggcaactgtaacacggtaatatttgtatatccaaacatagctaaacataggaagggtagagtgaaaatacagcatagaagacaaaaagtagtgcacctctgtggggcatctaccatgaatgaagcttgcaggtctggaaattgctctggatgagctagtgagtgagtggtgagtgaatgtgaagtcccaggacatcattgtacactattacagattttataaacactataaacttaggctacactaaatgtattttaaatttttttcttccttcaataataaatgaaccttagcttctttatgttatcaactttatttttttaactttttgacttttttatattaatacttagcttaagacacatgttgtataactgtacaaaaatattttctttctttatatccttatcctataagcttttttctttttttacattttaaattagaaaaaaattaaaatgaagacacacacattagcccacacctacccagggtcaggattatcaatatcactgcgttccacccccacatcttgtcctaccagatggtcttctggggccgtcatgcacatggagctgtcatctcctgtgatgagagtgccttgttctggaatccctcctgaagaacctgcctgaggatgtgttacattaactttttctttttaataagtagaaggagtgcattgtaaaataatcatgaaagtatagtatagtaaatacataaactgctaacagtcgtttgttatcattgtcaagtactatgcactgtacataattctatgtgctagattttatacaactggcagtgcaggtttgtttacaccagcatcaccacaaacacctaaataatacattgcactaggttgttgccaggcgataagattctttcagctccattataatttaatgggatcaccgtctgtagttgactgaagtgtcacacagcatgtgactgtatgcatattcacctcctagaacccagactcatacgaagaagtagggaataccctactcgcaaccatgttttatttcctagtttcttccattggccattttctttttcaggctggagacttccctcccatccccactggcgttcccagtctctctgcctcctaagtcttcctctgttgctctctggggaccagcttgtgcagcagttttgtatcactgtagggtagggcttcaatgagccctgtcctgtgtccttccctggctcactgcgtcttgccttcccttcctcgcacagcccagggcctgacaccacctcctgcagttggtcattcaggagcagggcactcagggaaggagacggctctgcttcgagtatagcctgggcaccatccacaaacgccttggtgtttgaactcacctgtgcatcccagatacaggtatagtctctccaaaacaaagggtgtaggaaatatttttacttctccatctttccaaagtatccttcccttagtatctcagcaaccttccccggagaggctctttgggctgtggatgtagtacccagtatcctgggctgcagattcattgattttccatgctttgattgggtataatcatgctcagagctgagcaaggttggcagtgagtgggtcactgacatcagcttattcatgatctctctgtgctccgattctgacatgaacttccttttctgtctcagaggagagagatttcagggctgtgagcctgaggatggaccaacacgcacgtcagttgtgtctctgaggactaaagatggccaggacccaggaccccagctagcctccagatgctgctggctgctggggacccgtgacctaaggcacacccctcaacacattttctttcattcctgtcaatctcctgtactggtgactgggctgggacctcctgctggcctccagggccccacctgagcctctggtcccggcctcagtcaggcccaggcctaggggaccggcttcttgtttcctttcccgagagctctctgggagtccttacaatagattccaacccaggcacttttgacagtgaaagaagatttgtattattttcttagggctgccgtaacaaattgccacaaacttcacggtttaaaagaacagaaatttattatctcacggttctggaagtcagaagtccgaaatcacagtgtcacagggctgtgctccctacttaggctccaggcaaggttcttctttgctttcctgcttccagtagctccaagcttggctcgtggctctgatctctgcctccagcctcccatagccttctcctctgtgtgtgtctctccttttctgtctcttacaaggactgagtactcaaacttatatctaacaaagtactggtatcaaaaatataaaaattactcctgcaattcaataataagaagacaaacaacttaattaaaaatggcaaagtcaggatgaacttacctgaagatccttaatttaattacatctacaaagctgttttatccaaataaggttatagtcacaggatccaggagtttggacccagaccaaccttttgtgggggccacaattcaacccactccaggattttaataataactattccataacaaaagacagaacaccatgactgtccctccattcacctgcatggcctctgaaacctaaggacaccttagaagtggcatctctagctcggcgtggtggttcatgcctgtaatcccaacactttgggaagccgaggccggcagagcacttgaaatcaggagtttgagacaagcctgggcaacatggcaaaaccccgtctccactaaaaatacaaaaattagccagatgaggtggtgcacgcctgtaatcccagctatgtgggaggctgaggcaggaaaatcatttaaacctgggaggtggaggttgcagtcagccgagatcgagccactgcactccagcctggaagatacagtgaggttctgtctcaaaaaaaaaaagtgtcatctccaccactggctccctgggccacagacaggcagggaggaaaaggactcagatccctcgtgtgccttccaccgacggcttcgcctcctcctctaacaggtctgtggtctgatgttgagtccatgtggcccccagtctatgccggaggtactccccggctaaccctagaagccagttgtattagtcctttttcatgctgctatgaagaaacacccaagactgggtaatttctaaagaaaagaggtttaatagactcacagttcttcacagggcagcaggagagagaatgagtgttagcaggagaaatgctgggcacttataaagccatcagatctcacgagactcactcactatcatgagaacagcatgggggaaaccgcccccattatccaattaccttcatctatctagtcctaactttaacacgtaaggattatggggatcgtaattcaagatgaggttttgggtggggacacagccaaatcatatcaacgatgttatcctgtcagaactcaagagaagggtgagggctgggggagggccgggggatgatcccatctgaagtggccagtggaagcagttggccttctggagagggaggcaggaaaggctaggaggtaggtggccttggaggcccagagggtagggggagaacgtgggggtggagtgacagctggacatcccgaggtagggactggaaaaggaggcctagggagttccagatgtacccacctttctctttgtaacttaatgctggttgcatgacctgtaggtaacgttgcaggggacttggggtacagtatgagctctgtggttccctgctttgagaaaaggaatcctctttacaaactttctatgtgattgtggtgggggtaataataaagagagccccccactgcccaccacaagggcagtcagaggacccacattggccagagtgtgtcacacattggacgtgcttattaggttgggatcagcacgtggacagcagggccaactagggtccattgttaggaaactgagtgctgggagagcagttgtctctccttcggcatgtgctctaaggagtctgagcttggacctgctgagcaccatagctgtctcctggggagactgtgtctgaagctggagcccaacagagccctgcagaggccagagacggggagggaaagttcaggaccttgcttggactcctggatccaacctcacttcaaagtcatggtcacggatttcccagttagagagctcaccttgagaggtggggtctctgtcccatcccctggaatctaggtgagctctatgacttctctgacccatagagtgaggcacatggtgctgtgcccgcttctaagctcagggctaagaggctgtcagcttccacttcctgcctttctgatccagatgccatgctgtgagaaggcccaagccacatggaggagctgtgcctaggcctgcagaccacagccctcactcggttcccagctgccagctatgtgaggaagccacttgggatgtccagccctgtcgggcctttggatgactcagacgccatctgactaacccagggagagaccccacacaacacctgcctggcttagccaagccaactccttcaactgtgaaagatggtgacaaattattgttttaagccactaggttttgaggttattatgcattatttgaaaataattaaaattatttcaaaaactgtttattgtgactgatatggatgcctaaggtccttgcataaatgtgtcctcacttgatttagatgccaaaataggaatctgcaccttgaatctcatcatgagctccatgaagctttgggtagcctcaagaattctagagtgcaggggcttaaattcaaataactctggcagaacactgatggcctccctcctctggctgtatcatgcacagcctgcttcagctaaggggacagaaggagggagccagcatttctctgagaaccaattataaacaccttgggggaactctcatgatcagtaagatgctttctgagcatcgctttatgcatatgctaagaagctggggcaagagtagctttttttttaatagtacattttatgtaaatttttactgaagtgaacagacatatacaaaaatacacaaattataattatatggttcgattaatctttgccaagggaaccatgtcaccagcactcagattcaataattgaacattgtaagcacccaagaaactgacttgcaccctgtgttgatcatgcccccccaacagtgatagtcacctcattctccagaggccttaggcattgcctcaggatcatggtggaagcttctctgggtggggctgcttggggaccagccatcctgcagtgggcccatgataagcacctgtggcgccacacccctggctagcaggcctgctgggaacacctgtaggaagaccttggcaggatcattggcccttgagtcagctgcttgctcaacttcatgatcagagataaaggtgaatgcaagtactgtggccatgccatgcttaggactcgagaatggtgcagcctctctgtaggccagggaaggaccactaatatggctcccagccaagggcctcagggattctgaatggcacagtctctgcagaacttgcactgtgtggcttcaggtcttccaggacagctaaaatgtgtgggccttgagggtgcctttgggtgctcatagcctcattagggagatgaagaggtgagcagatgtcacatatgccaagacagtggaagcattaagaaaggggaaaggatggggaggatatcaccccaaaggtatgggaaaggacctggtatgtctggaaagtgaagaaggccagtgtggctggaacaaaaggcacctggccagagagctgggagatgagggcagacaaggaggaaggggctttccaggcaaggctgaagcctggatttacccagaaggcaatgaagagccaccagacactttaggggggccatggtgttgtaaaatgaagcatttgggctttgtcccaggttcctggaagggagcttggcattttcagggtggcaggagtgtctttgctattcatcgtgggtccctggggccacaccggagtttatgctgaccaggtgcttcaaggtgggactccatagcttcaggatgcaggctggccaaccatggcaagaccagccatgtgaataaagggtcaggactttgagccacatgatatcagcctgacctctggggagagagtgggtattggaattgagtacaaaggtgtaagcaatgatttcatcaatcatgcctaggtaacaaaccccaataaaaactctggacattgtagctcagtgcagccaccctggttggtaatcgtataaccatgttctgggaggcttcacatttgggaatctccccaaacctctccctgtgcatcttttcatttagcttgtcctgatttgtaccaatcaataaaactggaattgtaagtgcagaggttggtgagtcattctaatgaattatttattcaacttgaagccctgagtgggagcctctatcttggtagccagtgattggaagtgtgggtgcactgggaatgcagctggcatcctgcagggccctaagtctgtggcatctgtgctaacatcaggtggttactgtcaagactttcttcactcagtcaggtctgtgcttcaggtgcactgctctgtggagtggggagggggcctggagtgcatttctgctcatggggctcatgatttgaactcaggcctaatatgttaatgagcagacacctggccaagccctgggggcctcaaaaaaccaagacaggggaagcatcaagaatgtgatgagagagtacgcggccatgggagtgtcacctttgccttctcttctccctgtggctggaaaggctggcctgtctggctgcccaaggatagacggggagaggtttaattgaatcacctactgtgttgggtaaagtaaactgtcgtcattgcaaatataatcaggactgtattttaacagtagaaaatgtgattataatgacatatttatcagctcctttcacctgggtggatctgaggacatttcagaaaacaagtgattggaattgcttggcctacctcacacacttacacacacacactctcacacactcacagagacacacacttataagcacacacagtcctgtgcatgcacacaagtgtatacacacccacgcacatttccacatgcatgtgtgtgcacactcacatacacaaacacacagagacacacccttacagggcatctggtgctctggcctgctctgacacgcagcccctcctgggagtgggcagtaagcattggggggacatgtaggtagtccctggggaagctggaaggctgaccacctggcgagcagcagggcacactcactggagcccctgcctggatgagctggctttgctcagctccagctgtggttccctctgtagactgtgggatcagaaagccctcatcacatgatgtaactctcacaaggctgcaatctacttccctgtccaggtcccagaggctccaggctctttgtggagtcacctgcttgggcagccacggttctgtggagctgcttgtcagagagtgcgcaggctctggagtcagtcagacctgggtttgactgctgactccatctcttacctgctgtgtggccatgagcaaatgcctgttctcactgggactcagtttcctcatctacaaagtgaaacgtgttcatacttcccttatggtcagtgaggatggaatgggataacattctgcaccccgcctggccccacaggcatatgaggtattcgataagtgaatgattgtgccagacaagaaagctgcctgccctcctcctcctcggccctgtgcagggactggggtggatgagaaagcccgtgtttcctgaacacctgtttgcaccaggcacctatttggctgctgcctggatgtccttctcaggttccagctcaggtctcttggaccagtcccctggtctggggtagggatgcctggaacggctctagcggcaaggtcatatctcgccaggctgccaggatgagctgagcattgtgtccacggtgggtgtctgaaggaaataatgtatacagtggtccatttccaagaccaagtgccttgaatcggcttaggtcagcaaactatagaagcaacaggacatactaggcccctgcttggatagctgctgcctgcttgtcggcctcccccttcttccctcttccccacccccttagttgccctcacccgaaccaaagaagtttagataaaagtttattagtctgcaagatagcttgatttgtctcttcttgtcagcctgcctagctacttaggtcataagtcaaacacttgaagagcccctgagctgactaggattgcaatgcattgtgagctgcaacaaaatgcagcaagacaaccctaaaaaaaaacacctaaagcccctacctaacaatcaataggcaacatccgggaaaattgtgaccccatagtactcagtctatgagcaactgggggagggacccgtactctagggataaactgcttgtcgaaactgctgggtgtgcttgtccatcagacacctgatcttgcaagttcatcattaaaagtttcactttcgctgttctctgggtatctgagtccattctttgggtttggacgggtaagtttgtttctcacatgtacaagccagaggtccatgagtgagaatcgggggccaaggagctttgtccatggggccgtaatgggatgagagggcagaggttatcaaactctgagggctggaggaagacatggtttctacctcttatctcatttcctactcatttagccttcggaggcaggcactgccgctatcccaccgaggaggagtctgacactgtgggtggtgaaggccacagttacccggtgagtagctgggctggactccacccttgctccctcctacaatcaacctcctgctcctcccaacaactttcctgaaaggaggcagtgaccactgtgcccttgcagcctccccggcaaccgacttctgaatcatcccactgcagagatctcattactgcagtgagtgtggctccagcctcccctcccttggctgctaatgagcgccctaatttgattgcctccaaatgagtgtgatgcaaaattaaaagatgccagaagacatgaccataaatccagtgagttggcttcaatttattatgtttgaattcaattagatttctcctccgatgttttccgaatatttatctagctgctggctacagaacgataactggaaggggctattactgtttaattccagcctcctccattcagcttgggctctggcaataccgttggatggaaaatctcagcctggatgtggggaggtcaagggagttcaaggtcagctgctgagccttctgccagccagccagcatatttcctgttggggaagggattcaaagcaatataccctattaaaatgttttaaaaatgatttttagtgcataaacactacaagggactccacagaagggagtgttggtgtcaaggcctttgttgtgtcacaggcagcaggggggatggggatctggggtctgggctcagcctggccacgaactttgtgtgacttgggaaaatcactaaccttttccagccttggcttctccatttgcaaaacgacggagttggactctgggaactgttttcagtggccctggattctgcactgctactctccttttagtttcagggtgtttgcccactctccttccccacccccacagccatgtgtcctgcttgaccctgggaacctgacttctttaagctgcctctcaggctttcttactgactgggcagaggttggaattagccagtgggagactctagctggaaggcaaaagtataggaagagagagagtggtcagtgtatccccccaccccgtccccactgcccctccccaaggctgtgtctctccaagacatcagctcctgctggaaaccccttctccacatctctagctcttactggctgtggcaacactattcctctctgtctagccccatgagtaacagcatcctagagttgtttgttttcgtgcttctcaacatccctgttcatcctcttcacctggccacacttctgtaaggactactgccattaaagtctcatcatttgaagcattcaatgccatttcttgccatgaccctgaacaatgcagatactaaatccatttttcgactgtggttttccatggagggctccccaggtctagaggggagctgagacaaaagcattcccggcttgggagcctgttgtgcagttggggaggtcccagagcaccaaggccaagctggggagacgttgtccctatgggcatggccaggcctccggcctcagggaggagagggagacggtgatcatggaggggaggccctgggagtgagaagctgggggaattgttccaccctgcccctccccccaacctccagagagcgaaagacgatgggatgtgggaggacggcaaaggggaagaggaagaggctccctgtcctgctgggtccttagccaagttggaagtgggagagtgagaagcccccatctagggtaaaggagtatgcccccaggggaggagagaaaggctgatgacacagagggctcatttgctctgaaatgggcctcccagtggaacagtgacgaagaggcagagtcagccgtggcggaagagcaggaaggagaggagtcccagagcaggatggagggagcatcagggagatgggtggatggccagggctggcctatggggcgatgaccaaaggttgcaggggtgggttcaggaatgagaccaatgaagtctcctgatttatggcttccagctttggtgtaagtcaatgacccgaatccctggagaagggtggggaatctgactctgaatatgtggcccaggagccctgcatgaaggagctggggcctgaagagtaactctgcattgagtactaggcttccaaatcagatcctggccagctgctgtctctgatggctcccagtcctcccctcagacccatggctgtaggccagactggcaggggcaagaggcaggagccaagtgggacatgtccagtgtcctggccaaacatacactggacgcagatgagccatatgcctgggaaacagagaaatggggtgaggccaggtcttcttgtgagaatgaatgtgccttactctctcctggagagagggtgatgacaagagttcattcattcattcataattgctttttgatttaagcaggcgagtttgttgtttaacaggctgggaacatctctcttttattgaaacatgtgacatagcaggttaaactcctaaagattcagcacagcagatgagaatcaaggagtttccttcttaaaaagcataacttgcatatgaatgaagatgattccaaattatgttttttccccatgaccctaaaattttatcccaaaaggagttatcatattagatattgatcagatcagcatttcatatcaaagctcaggacatccatctaaatatttaaaaatctttcactctcacagcacatcttgtgatcaatgtaaaacaaacagataggaacaaatcaaatatgagagaagggtttatggtgagagaaaacagtttctatcctctcccctccccagtcctggcctcactctccagaggcaacttcttgtaaacatttccatttttagtacttctggtgggtgcctccacaatgcttagtagcatgtataggcacccttatttttttattcatctggagaaaatttatctacctcctgtgatggaacataagaaatggcctcattatgcacctctgcttcctcccttcatccttccaaagttttatcattttggcataattatttttagttttctgttatttacttttaaaactttaaaccatataattgtactttgattctgcattccatccacctcagggagagtaacggtctggggcggtcaggttgggtctgttcccataccctccccttcttctgaaaggactctcccctccctcccgggggcctgtgcccatgaccagccagtcacagggccaggcatatgtcctgggccctggccactgtgggatacaggcatgctccccaatcttgaccactaggaatcctgcaggactttcactactaaaactgctctcttcaggtcacaacagtaactatcagttcaactacaccaaaggtttctgaagacaatggcttctccacccaagcaggttgtatataaattccaaatagaacttggcatcaccctgaaggaattctaacttcacactgttggggaaatttaccaagatagcttcagagtaaactaactttacacagcacattaaaacaaaagacatttattcagcgtcatgatcagactattacatttagcaatcaacagcatgggtgcaaaaaaaaaacctatattaaaacccttagctggaatgctttacacttcccacagaacagaaactaaaataacctgttatacagttagtcacaaatacagtcctcgagttttttgcccatacacatgagtatttgtctaaaacatgtcttctttgtagcagctaggccctgccaccactgtgcttggctgagttcacaaatctgtcgtaacctgtagattccctgtcatttctctggctctcctctcctgctaagctttgtttcctaattaaaatctgccactgccatagctactgctgctgctggaaccgccaatagccaccttggtttcatggttttgcaaagtataggcctccattgccacaggggccagagcttctgcctccaaaatttcctcccttcatgggtccaaaatttgaagactcattgttgtaattgccaaaatcattgtagcttccaccacctccaaaattgcttccatcattaccaaatccattacagccatccccactgccaccatatccaccaccaccacgactgccaccaaagccaccaagaccactgaagtttcctccaataccaaagttgtcattcccactgaaaccacctccacgaccaccaccaaagtttccagaaccacttcgacctctttggctggatgaagcactagccatctcttgctttgacagggctttcctaacttcacagttgtggtcattcacagtatggtatttctgaatgacaatcttatcgacggagtcatggtcatcaaaagttacaaaggcaaagccccttttctagccactgactcggtcagtcatgatttcagtcaccattaaaagggattacccaagcaaaatcatggaattattggttataaaagtaattgttggcacatcctatgtaacatatctaattgaataatggtaccagattaaattatagatgggaatgaagcttgtgtatcatccattatcatgtgtaatcaataaacaatttaattctcttgaaaaaaataaataaaactgctctcttttgttctgggattacctctaggaaggaaatgtaaagtcagctcttgtagggtgcctccaggcccctgacacgtggaaagatcgtgcaggagaaaaccaacccagaggtcagtggaggtggagaggaagttgtgagagagatcaagctgtggtggtgagaaaggcagctggtcctgctcactgaagcctccattgcttccggactgtcacagttacaccgacctgacaatttcagtattagcattagagaattgtttcagctttccaactaacacagggtgtattgtactccccacctcaggtaagatgagaattagcacgtaggctgcctgtgctagttttctgttgctgctgtaacaaatttccacaaatttatgatttgcttagagcaccacaaatcttagttctggaggccagaagtccagcatgggcctcacggggctaaaatcagtgtcacagggcagctgtgttcccatgaggcggctgtgttcccataaggctccgggtggagactgtttccttgccttttccagcttctagaagctgatggagttccttggccagccactttctccctccattgtcacagcaggtgtggcttcactctgacctcttctgcttctcccttccaccgaagggcccctgtggttacattgggtacacctgggggcttagcctgtctaatattgccacaccctcttgtgaatcttcttttttcttttctaagagatggggtctcgctttgttgcctaggctggagtagggtggtgtgacggtaacaaactgcaggcttcaattcctgtcctcaagcgatcctcctgcctcagcctcccaaagtgctgggattacaggtgggagccacagtgctaggcctctcatgaaccttgtcttccagaaatgtgttggactctcatccattagtaagccatctttctctcttttttaatgcttttcccttatagatttacttcattttaaatttataagcttaaatttcagtgatgatgtcttaggaagaacaggagaggaggaacaaaggaacaaacttctttaatgggaagctgaaaggacccttttaaaagtgtgcagtggagagatcctgggcttggtctctggtaaacctggtgaatggtgggttaacactccctccctcactcggtgttgctgggaggataagacagaacatgtggcgagcaggtgtccaatagctgcctcttgctatgtgcagccagtgccacatccaggctgagtgctgtggggagtgtggctcatcccactggggccacccctggcctcgctcactggagactccagaatcagggctgactgagcagcttgtggcactgaagaatgttctaggaaaggaggtgtgtcctccttggaaggggaagcttcatggtgggtgagctgagggtaaggggtgggtgagggccatttgaagagtcacctcccctacattcttttatcttttggagcctccatccacgccacttcaaacaatgaacacacacatccaagtcagtaagtgcactttgtgtatatctatataagtgatgcgcaattactgtataacagttcactagctgacctgacattattcacatatcgtaggcatgtgactaattgtaggtgtgtaatgaagtgttcacatcttattacatatttaattcctaaggcatttctacagttttatttgagaattttggaactgccagtgtgtttttcatgtttcaaaccttttcacaggccctgaaaaaacccaaaggccttatattctgggaccgtaatggacaaaacagccctgggaagtatgcttgggaggatggcgaaggctgggtttgctgagggaggtgccagctaaggtgctgggcacaccagaggcaagggatctggaccacaactgtcagtttgatgaacacactaatggtggagtgacccccaccaggagtggccagcaagcagggtccaacaggaaagacatctgggaggccagcaggtggaatcctggctctgccaccttcgtgctatgtgatatcagccaagttacttgccctctctgattctcaaatgctcggaggccctttgacctctagagtctatgggacctgagtgaccacagggctctggtttgttggtggctgcctctttatttaactccttttctcaaatacggtctatgggctttgcttaaagtgaggtgtcctgtgcacactcttctccatgactttgaggccgtgagaaggcccgccctgcagaaggactgaggaaactagtgctggagtctcctttcttgtatcagtgaaggaaggggagagaggagataaagtgctcaggttacagaatgtgaggatcgtgccccttttttccaactgaagacattcctaggcattttatctcccctgttgcaacttctaaatcacaaaaaccttatgcatccagtttggctgacatccacctgcaatgggagtgagtgagattgagccactcctcaggtgaatggaaaattaaggccaaccaaggcccaccccatgccccactgtggggtctaaaaggagcaggcactggcctgctttctttttccctaaagaaagctctttggggacccagcagaaacagcagaggtggggatgcgagcttccgcctgcatttgttccagggtgggccagtgaggatttgggaggaatggtgtggaaaggccctgcccaagaaggctggatgctggctggggaatgcccagggtgccagctccctaccctggggaaaggccaggctggcatatgccggagccagggtccaaggtcacagagaggccacacctgggcacccctcccagcaagggaaggtccaagctgggaattacttctctttggaaagtgaggggagtggtacagaaatagtgctattgttgctgttgtcctgtcacttctggcattggaaatggtgttgagcttctacgtgacgggcattggaggtcaaacctgaaacaggtgaggcccatccctttactaggctcacgttctaggtagggaggaggcaggtacctcctccacctaagaaacaacaagagatagagaatgcagtaactgtcctaaagagaaaaaccaggggatggagagagaataatggttgtcaggacgggtcagactttaggatggtaaatgaggagtggtctctgagaagggatgaggcagaggaagtgaggctcagggaagtgaagcacttgcccaaggcagcctgctggtcatggcagagctggcaagctcattccctcctcattatgtcaaccttctgggaccagagtctgggcagggcagaaactactgcaccaggggtgcgtggctccagcagagagagacaaagtgccccatgcaatccagaaactgagccctctgggctcaatcttcaaaggaatgactctcagagttgtgtcccctgccttttcttcaccatggaacttttcccagctccactctggtgggcttggggacaggacctgccctctgcaaagtgatgaccaaggataagtcggattttcaaggagaccttggagaacaccaccctcttattgtgcaaaagaggaaacaggtccagagagggtgagccattttttcagcatcacacagctgacctggagcagagtttcctaaaagctccctcggtgctctttcccctgctgtggctagacccctccacaggaacttaacaggaacccaaaggaacgagtcactcatggcagaatcactaatgtgatggagggcaggagtgagagacggcataatgtcaatgctggcacactcctggcacacgggaagctgtccatgagtggttgcttcccaccacttccatcgcccagtttgggacatgtctgagatccagtgctgagcccagggtctagcatgtcatgggagctcaggagttcctaattgactacatgaatgctaaggtgtgggatgtgctccttcctgctttctcattctcaaagaacactcttatacacctggttgtggggagggtatataggcaatcaacttttgcgtactcacttccattgtaggatcatgcatgcatgtggacgtgcgcacacacacaaacacaaatgcacacacacacacacacctgccttctcaaacttgtgggaccagaaaggatgctgcaaggcctaagata

SEQ ID NO: 623 - DNA, 1102392 bp, Homo sapiens
aaaaaaattattccatgtggctaagaatgtggacatttgttttaatcccaaagcctccaggtagtactaccagcttatgaatacccttgagtagatgtcctggaatctggagttggctgaaagatgcataaaatcagtaagtcacatatggctagtctccagcccctcttgtacacacatctgtggagatcagggaacccatattcattattccaattcattattacacccatttggatgtatgaaggttcagcagtatggtgtagccatccctgattagtggaaatggttatatgtagatatgtatgtggagaaagcaatgttaaatcttttaaattatagatgataacacttaattttaatgtaggtgttcaaggaatggatgttgcaaagtactacagaattccaagatcccattattatcaatttattacttgtttgagataattaaaagttgtcgttgttttgttttgttttgttttgtttgagacagagtctcgctctgttgcccaggctggagtgcagtggcgtgatctcggctcactgcaagctctgcctcctgggttcaagcgattctcctccctcagcctcccaagtagctggggctacaggcgcccgccaccacgcccggctaatttttgtatttttagtagagccgggtttcaccatattggcccggctggtctcaaactcttgaccttgtgtccacccgccttggcctcccaaagtgctgggattacaggcgtgagccacggcgcctggccaagtttttttttttttttttaatagaccagtcaatgtttctgtttgatataaagtttaaggccaaagagtgaggaactagacagccctgattccgtccctgatgtttcattctgaatttattacgactaatattaatttattagttttggtctatttttaatagctgatggaagtattttcaaactgtgattatctagcatgttagctgttctttctagcttcaagtcttcatatttgattagcatgtatcatatcagtttctactgcatgcctatggctctcgccctatcttaaagtaaaacaaaagtcataagatgaaccattgtaagtcacactgtcgtaaagtagaaagaaaaatcataagatgaaccattgttaagttcttaatatgaaccattgtaaaataaaaaaaaaatcataagataaaccattgtaggtcaggactgtctgcactttgtacaacttctgcaaataagtatccttcaaaaaccaggacccagaacagcatgctgtgggcagtcactatgacttctaacccaaaaacattcaatatttaaattatttggatgtagctatttaatcatttaactatttccttatctgtaccattaccaatgtcatatctttttatggtatattcacttcttgcctaatgcatctttcaaaacagaaaatgagataattcagtttgctcttactgaatttatgctgatttttaacttcttcctttactaatgctcccaagtcaaaagctgaatgacgtttgtaggattcctttggggttagatctcaatctttctgatttgtttccatcttttccctacttcccctacaacatccacctttttctttgggaaagaacctggagcaacatttatttttcatcagtgtggtatagtgatctcttacaaaagcacttaaaaatatagcaggtgccttattctggatattctatatatgccctctgagcagaaggcagacaggagtactgtacagtaagaaaaggacatcttaagtttaaatttggcagaactctaataactaaggactcggcttgaatatgctgagagcagagggcagagacaaagtatgatccagaaaatgaagtattagattggccggcgagggtgagagaagcaagtaaatcaagagatggaatagcggcaagtgagacttttggaaccaaagtagtgagagcggcttgggtgagagggagattattagtgagagagtcagatgagtaaggattggccaggagcaaagttggttcagtacctgtctgtggccctgatcactgtattttttctatctgggatgagctcaggctttaaagtggtaatgtcttgcaagacactttggatttaaattcatttaatgaaggtaagtgtatttctacaatatccttaggtatcttaggttttaactctcaaatatattttctctactctttttagttctgataaaattctttatgggattctagaaagataataggagtcaaacagttctctctaattataatttaacagtgtaccacctgctctaagtagtgagtattaatagacaaaatatgttgctatttttcctaatattttctccaaactcagatcatttgaggctttagcacttctgacctgtccttaaatcttgatgccacccttttatttcatcattggtaatgtgatctgtcttttctcatataagcaccaaacactgagttatctaaatgcataacctttttcttacttcttaggaaacttagtgattatataatcaaatttgtacttgtcagcttctcatttttcttgatccatcttcaggttagagttgctgactataagataatatctattgttttctctgaacttcctgaaattaggtttactaaaggtgggatacttgcatttctaagctcagacttcctttcattggcctaataaactctaagttaacgtggaatggttactttccttcaagattcctttagctgccattttcttcaaacagacttttttagccagaaataagccaaagcagcaagtcccctcattacttgtctctcttttgtgagactgaatttccaacaaggcaattcaataatttttccgatgttttgcctttagtggagtgggatttccatctgaagtttgcaaaggctttcatcactcctctgtcttgcctgtccctattaaccatctggttacaaggtctctgaggcagtcccagggtaacattttgtttttctttcatttcactctcctgcagctgcttcctccatactccaccctgaggtttgtggatttccatgcatgtgtataatttttttgatagatactgcttctcccctagcccttccatcagacccatttattccagacaagatacacctttccatgccataatctggtcaggaatcacatttctacaaatccccataagacttaagggattattttaccaaattctcttcagtttttaaagttcagtttgataattttcatctgctatgtgttggtacagggacaagtgagaatattaaccttgttcccagcccatttctctggtatcttttggaaattgctgggcaaggcctccactatttttctttctgttccctcctgtttatgctccatagtatccaatatggtcttgcagttttatctgagtactcttctctttcctttcacaattcaattgaaataataaagcactcgatcaggctgactggtgtcccgccaacactgtcttgccagtcttatgagatgcagtccatctcttactagaagcagcaggaagaagagatgaaaacatcactagtgcccctaaaccattcattttcctacgcagaaattcaaagacgttagagatacattcccggcttcataaagagaatgagaattcattctcatatatatcaacagaagtggaaagcattcgggggactttataagtcttggcagactctcaagtctctgttatatgctgcctgggaataaagcacgtttctcatttaactgggccaaatgtgcacactgtcacttcagttctctcagcgaggaaacgaaactgcctcctgtaggaggcattgtctggtttcttttctctagcacaggtgaacctgtagaatatgtcaggagcttcttcagaaggtccttgttcatcttttagaaggaaatctttatactcattgcaggaggccaggtttctttttcttcttttatctcattctttcccatcagccttccagtacttcttttgataccctcttcttcctcagaatctttttctttctgtttcccttatggaattggtagcttcataatatgggccatacgcatggtaaatgctatgctattatgcattggaaatgaagatgtggtgttgataaaagggaaatcatgcagatgccaggctgtccccagggccccagatcattcccaggggtaggacggagggcctctgaggccattttgtttgttttttttttttttttttttttactttcaaggggctaggagaatcaggatgtatgttgtctagcaaagatttctggttctcaaggactctctagtccctggataacactgggcataaccatgcttgatgttcaaatgaaattcatagcagtttaatcagttgatcccattgcttttttatattctgttattaatactgatttataaaacccagttattttcctcattattgcttctcagttctgtgctttctatgaattccaatttaacaaaagaatgagtttaccattttgatgtcactatctgcttgatccagggattatgtattggatttaaggtcccatggctgcaggttattacaagtatgtttgaatactgtgctttgcaaacatactgatttgcttgaaatgccaccttccttttctttcttatttctatgtttcatgagagacagcagaggacagtgcttaagggcccaaggtttagagctaccctttggaatcaaatcttggctttgatatcttcctagctgtgtgaccttaggaaagttatttaacctttctgtttatcaattgcttactccataatagcacagagggttattgtgaggattaaatgagctaattcgcaagcacgtagtgatgcttgaaacctcataagtactcaataaatattagcttttattattaattctctgcttaattaacactaatttattaaactccattttaaatatcaccatctctgtgaagctttccacaattacccaaggcagaactaatccctttcactcctctgttttcccagagcattttgtacatatttgattgaactgtaaataatttttaacatgtgtctttctcccttgctagactatgagctccataaggatagacgtctttctttttaaaattcacgttgtattcctagtttctagcacaatttctggattgcagcaagtgcataataaatatatgttagcactacatctccatcgagattacaaacatcctgagccttggaccatgccgtgtctgtttttttgaatctcctgcagtccttagcacactgctggtcacacagcaaatactaaatacatacttgctgattgactgatattgaaactgcctacctctgaagaaatagaccattaagtcattaaggcatttgaaaggaaaaaagaacaaaagatgagatctactgagcatagcttgcttagaaatattattgttgcattcccaaccagggaagatggggtagatcagaaacttgaatgcatgactgaaaaacttgttcagacaagaggggcttagttaactttgtgggacactggggttctttctacagcagatggggaataatgtgctgtggaagctgagaggataaacaaagcagtgtcatggagtttaaactatcgaacagaggaatctataaagaggccagcagagaggagggaagaaacaagctaaaataaacagatgggtggacagagaaaatattaagcatgaaaacagataacccaggtcctccaggaaaaagggaagtaggaaaaatggtatgtcaagaaagaagaaacactctagggaaaacactgaagtaatcatgtagcagcaattacatggcgtgcctgggtgtgtgctaaaaaacagcaataacaaccacaataaaaggacaagaagcaatgtctgattcatgtgcagacagaaaatgactttaaagggaatgtggccgttaatatcaacgtggactgaaaaatcacacagccacatcatctagatgtggtctgaaataatgggcaaaatggcagggacttgtataaaaatgacaataactgtggctcctagaatttgaatagagctgtgctgtgtataatactttcacacatatcttttcatttaaaacaatggagttgaggccttctgacattatccagtatatattttccctcctgccaatcccttgcctggactgttacaatagcttctaactggtctccttgtttctgcccttgcccctctagcaaactgtatcaacactgcagccagaaagatcctttgcaaaaataagccagatcatatcagtcttcctttctaaaagccttactggtttcctgccaaggactttgctatttcagggtctttgcactttctgttcattctgaatgcagtgttcttcccctggatacccacatcattcattccctcacttttttaggtgtttgcccatatgccattaaacaggcaggtgttccctggccagtctctctagtaatttttattctcctaagcttgttctattttctccattacacttgtcaccatctgacatattatgtattcatctgtttatttgtcattgtctgtttctccctactaaactgtgagctccatgagagctgggattttcactactggattgtgccaatgactgctatagtaccggaacatagtggttgcacattaaagattattggacaaattaagaaacatacatggatgaatttgacaactgttgccaactagaggtggaatttcattgattgcatatgcgagacaaaatgaaacaatacaaagtattggtaaaacaatcggtgctttctgaccttgtggaccactttcctattcttaagacttcctttttgtatttcttccacactatcattttattttggttatccttctctttctttgatcacttcttcacatttgttcctccagaactccctacttcttcatagagtattaggttaagtaagaaataagaaaatacatgtgcagcttctatcttgggtctggaacacagtgggcgttggaaatgtcagctctttctcctttatatcctccagcataggcccataattcctttatcaatttcaatacattcaaatctaagtttttcatgctacaccccaaactcccctcaaacctaaaacactaacatcaaaaccttaactcattatcttttatttttctttatctctgtggaaccataaaaaagctggacatcttagtcttcttattatcagctctttactatacctatgcctaatataatgagaatcactgactcttggaggaagaattaacaagactttattaatttcatctctgtttccattaccatagccaattaccaaatccaggaccacattatggcatacctgaaatattctcagttccccattcccttctaatctctacttagtctacagggctccttaaatgtcacttcctcaaggaggctttcattggccccttcaatctaaattaggtctcactatgaaacagattctatatatcttgcattttttctatgtagctcatatcaaaaaataattttatcttgttagtgtgattccttaatatctgtctctttctatattctgtatgctttatgaggacagaagctgtgtatgttttatttattgccctgcagaagctcaattcctagtgcattgcttatctcatggtaggtatgcaataaagatttcctgaaaaatacataggcttcttcaaaacttccaacttttttggcctccagagctttatgtatttctattttcattcttcagttcattttattggacaaaatggaaatgaatagtcatcttaacgtggatttctttcaaactgttcatttcaaatattatagctaatagtaacatttatttaggacacatttggtgcaggcaccatgctaaaagcacttcacacatcatctaatttataactctatgaggcagatacttttattatttccatttcacagattagttagctgaggcaagttcatgcagctatgaaacggcaatgccatagtttgaacctaggcagtgtgacagagtagtcccatgcctaattcaggaaattctttcaccataaatataatctgttaaaattttacaaactttgctttgtatttcaatgagggcaatagtttctgaagacatttttatggtcactttctttaaatatgtctgcttgttaaaatgacactgggaagtccaaattcagcttcatgacacgtctctcctcttatgcaagatatcttaatatattgtttagactcctttccctctctgcttgccaaagatgtagtttccttaatcatgccctttctggcagcttcagctattctctcccaaacatatgcaagcatatgcaagcctggatcgttctcatataaacaaaacaatcttttcctctactcgattcctcttcttatccctttcctactgacctttctcaagttactgaaagtgtattctgcacactttgttgttactttctcagtcttcattcattcctcaaattatcacctcctggattctacttctcatcattccattgaagctgcttcttgggtcaggaaaagctaaaatgtgatgggtctgaaggttatgctaaggagcttaccttaggattacggttacaatgggggaattttaagcaagggataaaacaaacagtcctacatttttaaaagactccttcataatagttggagaatggattagataaggaggacaaaagaaagcaggacagttaatataatgttttagaattccaggaaagaatacgtaagcaacacactgaggcctcagcattatgtaaagaatgtaagaggagggagatgtaagagataagaacaatagtcattgctgactagcttgtgaataggatgagtaataagatgacatccaggctgaactgcagctttttgagttaggtaagatggggttcattgagacagaggactcaggaggaagagcaggtttggaaggaatgggaatcagtttagttctaagtatgatggctactgggttccttggtcagacgatgcaggtggaggtgaccccaagatatggtgacacaagtctgaagtatagaaaagatgtctcggatggagaatagttgagtcattgtgtaggaaacgtttagatttatcataaaggaagattatacagagagaaggaagcagagaggtgaatacagacaccaacatcatgttctttcaatccttttctactttccccaacctgttcttcagcttccatcatatgagactacacgctgctctctgaactcagtgattttctcaaggcccaccttcccctacctcttccatgaggttaatatcagaaggaaaaaggaatcatattaaacatatttcaaagtaaaggatcaaagctacaggacaagaaataattttgttttgtagaagtgtaaaaggggtattttaagtttggtattaattaaataaggagtttagaacccagaattttgaatttaattagaagttttcatttataaagatttaaaaattgtttattatggcacaaataattacttacggcataaaacttttttctagagattgaccatccttattagaaccttgtctaattcatttttgatttgtccttgaaaagttttggaaaactttgagaggttgaaaatttgaatataaagtaaatgatgcaatttatggtacatttttgtcactgaattataatttgagagatgaaagggatccctttaaaatgcaaatattgaggtcttggaacaactgtctatttggaaaaaaataaagttataactgtacatgatactttagagccaaacaaattttagagaaattgaagtaaaatacaaatattaaaatcctaaaacaactagatggggtaaatactgatataatcttatggtagaaaaggttaacctaagcaaacaaacggcaaaaatcacaaaatgagcctttgctagagatgattacacaaattaaagcttctgtgtgtgtatgtatatgtatatatatacatatatacacacacacagttttatagtataatataaatataaatacacagttttatatttataatacagttatttgttataacagatttaatctctaattttctaaagagataactgcatttataaaaactgaaaatgcttgcttccccgaaaacctcgccactatcagctactattttgttttttgacagggcacagcatctgcctagaaatgacaacaggtggaatgagtatggacattctggggagaaggccaaggtagtggaaaatccaccagacattgagaaaatctaccacagctgcccattaagatgttgacactgataaggtctaagatgctggtaagatggtatctacaatgtcttgaggcttatgtaacatgtaacaccaaggacatttcactctggataacctccaaagtaagacaacttaggagaggaacataaacttgcactatttttaataagatgccttattcctctttgatacttcagaaatctttatctacatccaagacttcacaattctttggtttaattctgactttgatttttttttgattaatgatctacaggctttcatgcaaccacagattttttgtttgctctgttttgttttttgtctaagttatcaatatttaatatacaatctctgaaagatttgagggctagaaaaggtaaaaatgctttcataatcatattgcacttcttttatttcaaatataaataatatcttcctttagaaatttttacacctaaggaaaagatgcctagagatggagattttacatttaattcaaattgattaagaagagagagaaagctgggagaattcctattgagaggtgaagccagctggacttcctgggtccagtgggacttggagaacttttcttacaagaggattgtaaaatgcaccaatcagcactctgtaactaggattgtaaaatgcatcaatcagtgctctgtaaaaacataccaatcagcactctgtaaaatgcacaaatcagtgctctgtaaaacgcacgaatcagcagggtcctaaaagtagccaatcacagggaggattgaaaaaagggcactctgataggacaaaaacagaatatgggaggggacaataagggaataaaagctggccaccccaaccagcagtggcaacctgctggggtccctttccatgctgtggaagctttgttctttcgctcttcggaataaatcttgctgctgctcactctttgggtccttgccacatttaagagctgtaacactcactgcgaaggtccacggcttcattctcgaagtcagcgagaccatgaacccctgggcaggaaccaattccagacacactatatctccaaatcatatagtagtcatagccacacattggcaaaaaggctcgtgaagggctgtaggttctggccttcgcattccattagtgttcagtttgttcagttcatacttttagtggcacaaaaataatttaacatgaacaactcaagagacgatttggggcttttatgctgttaaaagtcccaaatgttcattttatttagaatgatggcattgaagtgctggcacgctttgtggtcagccactccctttgccctttcggaactctgtattgctgaaattttggaacattgagtctggaccactgtttttagcatgagatacattttttttttcttcataggtagaaggaatttttaagggttccagtctccagttgactgctaaagatgaatttcagtgaggtctacttgagaacacataaaagcaagcttttcagctgatatttcaaacagaaaatggagatgtaggagtagagtgtcatcaaacacagaagaatgaatttcagtaactgcaaactacattttagtgatgatgatttcagacagaatgccatccagtaacacctccatttttctcattatgactgcttggaaacaatactgtcttgagggtgacagaaaaaaagaaggcgtggttacaaaagggttacctgaggaatcctggtggtgatgtcactgttttgcatcttgactgtggtggtggatacatgaacctccatacatgacaaaattgtacagaactaaatacaacacacacatagaagtaaaactggaaaaacttgaataggattggtagattgtgtctgtgtcagtatgctggttgtgttatcatactatagttttgcaacatgcaaaacaggtgaaactggataaagggtacacaagacctctctgtattatttcttacaactacatgtgaatctacatttctgtcaaaatgaaaagtttaaggaaaaaaatcaagaaaggtaacacatactcataattctatcttagtgtaatttttgttattaccagaaaataatctcctgagacccaaataaatgtccaggctttccagaggccaaaccagagaaagtttttccaaaactttcaagtgatcacattgatattgatgtgcttattgataattgagttgtactacatgactaatacaagatatcttggagttaattatgtattaaaataatttttaagtgactataagaaaactaggaatttcatcttaatatctcctgatacatttaatgtatataaaaatttccatgacatgcatgcttgccagtgttctaaaaagtataaaatatgcaaataaaaaaggttattttataatttaaatgcagttttcaccatggacagatgtttttaaaactttcattataattctaaaaccaaattagtgatacatttaagcagtaaataaacattttaactatatttgtatatttaaccagtaaagtaggcatacttatatagttggcataatttttaccttgatggtaggaataggccttttggggataaaacagtttctcttaagtggtgaaaaagctacattttgttctttcagtctaatcttgttttctgctatgattttcttgcgctgttccagataaggtccaaaacttggcagtttctaaaaggaaaacacacaaataaggaagcatgttagctcagagaagagaaaaatgggaagatataaacatataaatattatcaacaaacaaatgtgtgtctagggattgtttcatgtatactgtaactaggtcttcactcattgttttggaccactagtcttctcggtatcaggttccgttaattattaaaaagaacacaacagtacaatacttttaccaaatatgtatgtattacatatacaaatgttaattaaaatacatttctaaatggaagaaagttcacaatggcaaaccaaacccattcacataaaacaacagctattagttaaaccatttgtttggtttgtatagacagaaggtgaaacctattgatgcttttttccccttcatcaggtttttagcatgatatagacacagttgtagtccctgacaaatgcttttgtcaatagcaaaggtacttcgccaaagttctcatctgtatctctattttattgtgttcaaattcttactacatctctttaaagattgtaactaatgttgattgcaacttactggaatagctgaaaaacaaaaatggtaaaaatattgatttctctgtacagaaaacaaattttattttgcatggaggcaaaaatagaaatgaaaaggagaggaaatattacagtgcttaaacaaactccatcagtattcaaaatcacatcacggagctttaaatttcaaggttatccaattgtactttacaaagttcatttagaaagatacctgggcgtcatggaaaaatgctaagtggtttcaagttaacacgaaaatgccctcataccattcattatcccacaattattttctcttcactttgtccttcccctcttctagaaactttgatcttcacttttactgacacatactgctggtgatagacatcactgaattccaaatgttttgtgtcggcctgtaacctggaattggtaggtctctttcataagactgcaaaaataccctctctctcctgcagaataaagtccatttatctagctgatggaggtttggaaaactacagcactcgaaggtcatcctgatctctgacctagcaagtattttggtgaaaaatcacacttgtttcaaaacactggcctccacatttcagcttgcataacgccccaggaaaatgagttctctggtcctctagagacctcagtagagtaggtaagctaaacttaaaccatgttccaattaagccgaactgcaaactgcaactgtaattcatgttagcaaagaacatacttatgtagaaatatctaagattgttacttccattatcaattcattataattatgtcaacaagtcaagtaaatggaaacaatgttatgaatgccaaactaatttatatacaatgagactagaactgagtacttcatctctacaccttaatgctttcttaatttgtaatatttaattgttgcagtaatatgaaatgataggatggagggagatagtattttgtatccattttgctataaaacaagtgatactgacttgctaaaagcataaaataaataagagtataaaacaagtccttatcacatatataagcatccttaaaagacaatgcttttatgaaatggctttttcttggggcatatgaggtatatgaggtgttagggattacacttggtgccaaaaaaatgcctttggggtcagataacaccacataaggtggcgagcacacgtccacatgatataaatcttcagaatgtcaccccctgcgtgcttctcttatacctcaggggcatctcaatcctaatctaatatactcaaagactatcaagaacggttaagtgttgaaacatatgacctctggttctagcagatgcctcaggttagcaggctccatgaaaatcggaaccattattttccctgttggggtttacatggttctctgtttggactttaccttactcaacatcatctaatttcacctaagagttttgtaaaggccattcaaaagaaatcattcttgcaaccttttaatctatcttcctttaaatgtacatcagaggatagtatattttttcatttagattattatttatccaaatgcagacaatgaatgtagttaaatttaaaccataatgatttcaaattatttcaacaatggtaataagaacaataaatttttgaaaatcttttgatgctgaatataatacagcctgtgtaaatatccaacagcctgatattttctgtcattttttgcaatgattgaccacatttgccatacataaattatgttacacagccttcccctggctaacatgctaagtttctaatgtgctaattggttttataattagtcctaaagagagaatctcaatttaacataaagattcctacaggattttctttgtgcattggttagaagaattaatggactaaaaggaaaacttgccaattttttttaattgaaagcaaaaaaaaaaataccaaatatcagtgactgctccttccaccttccaccaagcatctccacatcaaattgggttcatttttgtttaattcctcactgctacatggagctctcagagactaaggtatagtaccagcttccaaaacttcaaggctgctgtagacattttgctttccttattagtttgaaaatttaagtgctttaaaaaatatgttgtatatattaaagtggtcctaaggctatttaagtactgaacattttaaaagtaaagttttccgaaaacaaaaaaacatcaattctctcccgcaacaaaggatcaaccgatcacctttacacatactacatttaggcatacatttgtgttttgatcttgcaaaaaaaaaaaaaaaaaaaaaaaggaagaaggataaagcaagcaagcaagcaaaacaaagctaagaaagagtgaagatgaatgcatagttggccactgtgtgtgtgtgcaatcagtgatgattaataaagcatttagttcaaatctctgcctgaacatatagttaattgatttcctattgcaggaggagaagcagcaggacctgacagtgccagcagcaggagcttttcctcttcattcattattttcttacagaaaagttgtagcctgcggtaactcaaagtgagaggttttgagcgtcatgctatatttcttaaacaaaggaaaaagttctttaggactatcaaaagctgctttgtaactgatgaactgaacaaagctcagaaatggtgtgagttttgtttcaatagtttctccagggattcatcattgatgaatttgttctcaccagaaaggctaaatcctactcatttaaagataacagtatcttacactaaaactgtctctatccagatataaaaaaagcattacattgccgatagaaaagtgacaacataatgaatcaacaatgataccttaagccagcaaagctttaaggtaaagaagtctatttggattataatttattcatggatcaatctaaagttaattgagcatattatgaagtagaaaagcgttcttgtttgtaatagaagcaagcacttgtatcttccagtttaaactgcataatttttatgagaatggcagcaagttgcctaatagcactagtctgtagtactgtaatggatcaactttattttcttaatcacactctcttatctaattggaaaccataacaagaagacaagtaattactttgatatctaaattgtaatatgtgaaagatgaaaatatttccggcttatatcagaatatatcactcagtatcatatatatatatatatatatatatgtatatatgtatcttattcagtataaacctgaaatctattatctatctatctatctatctatctatctatctatctcctttatacctatttcgtgtgtgtgtgtgtgtgtgtctatacaactgacagactaaaggataagttacatgtaaaggatatctaaaagttgacttttttttcccaaaagacatgtttgcatatgacatagctctattatttatcagtcttttgacatttattcaacaaatacagtattgaatatccactctgggccaggaactgtcctgtgctacactaaaggctaaacaatttccagacagtgtagtacaaattatcattgttattaattttgtaagtatcttttgctattcattaagggctagtgtcagattgaattatatgtcaaatatacctggttgttgcagttatctcaaggaataatatgccagactccttggaaaactgtttgaactcaataaaatgaccaataattgcagagaaaaatgaagaaaataaatgttcaaagagttgatctttaaaaacctcaaaaagctaattgaagtagttcttggatacctaaaataaaaaatatgggagcagtgtggtataatggttgagagcatgggttctctgagtctgtttcattatctataaaatggccattgtgaggtttaaataaagtaatccaggtaaagttcctaactcaccctaatttcaatctctgctcagcatgattcaaggtagcacaggagatagagatgagaagtatcttttctgttctgtagtttctgaattcagttacttttcttctttcctcttttcaattatgaaagtaatcagttacttacatttgatgctgatttttatttcaaaatcagttttagcatggtttagaatcagaagctcagattttcccatatgtaagtggcatgtaatgcttaatcaccgatataacagtaagcaatgtttcatgatattatcaaatttggacagtggaacacaataaaaagacagagacagaaagtccatctacatattacacgttaccatagtgctatgtgatggctaatgatgcaaatcagtacactggcattggacatgtaaaatatatgaaatatgagtattagtttaacctgataaatgtaagctacaacttttgatcaaatatgtgatatctaaattggtcaaaagcagagatagttcatgtttcatagtgaaagtagaaagtcaacattcacatagtgatgagggaaataatttagaagtcaaatttgcattaaaatcagttttgcactcattagctgtgtgactatgagccaattactttactattctgctactaattttccttatcaatgaaatgagaatgacagtatcaaactcacgatgttggtataagcattaaatggaataatatttgcaaaatgcatgcctgccaatttattcccataagccttaactgcttctattgcattgtgtactgtgctctgtgtttccatgtttgctcatgcatcccctctgccagaataccccatcttgtctttttcacctggtacatgccaattaggctatttagtttcagctcagtcttcataacacctaagtaatctcctttaccgattaccctccctgcccagtggtttagaatatcctgggcatattttaatctctgtgcctactgcactgccttatcatcattagcttatgtgtccatctgcccagcttgagatcctagacaggtaactttgatccagcacataataggtgctgaatataatttttcaaagcttaatgaatgaatgaataaatgaatgaatgaatatcttgaatatatttacaaaatctttctggttgtttgaattgtcaaacaatcccaaacaattactttcagaaacaaattaaagtatataaataggttttcaaatatgacatgaagtaaaaaatcgtacttacagaaaagctgtgattcatacattcagaaaacatttataaggagccagacacttgaaatttatatagaaaggatagtgtgtgaccttaaagagactatattaataacaattgcaataccctgtgggctgtggcagaagtgacacaaactgttatatgagcagtgacaatgtgtatctaacgcaggctgaggggtcagagattttctagaagaggtgtcatccgagctaaactctgaaggataaggtgaaggtaggatggcaagtggtgcagtggaggcgtgaggtcaggaaaggtgaagagaatcctccaggtggaataaacagcagagggagaagggtgacaatttggaaaaggcaccggggagccaatggactgctaaccctctgttccatcgttcataagctacaagagggtgaggcacttcacctgtgaaaagcaggcagaacacattttgttgtgaagtgatgaagtcggatcatgaattaggaataatgtcaatcaagagaagaaagtctaacattcatggaatgccagcaaaggatgatggaaataagacttgctttctgctaagtgctgtgcaggtgctggggcccaggccacaaagaggaccaggaggctgttccttccaaaagcagtttatagccttatgaagaggattgagtcatattcaaaggaactcagataagaacattattattttcatattgaaacaatttaaataactcatatcaggtctctctttaaaaactgtcattttttaaagtaagtatttttgaagaaatacctctaggttgggatttaggaaatgtggtattgatggcatgttttaggagaaaccagaacaaagagatggtccaagcattatgcatggagaaatgtagaattttgaaggagagggggaatagaaaagagaggagagggtaaaaggaagtgtgaaaagagagggcaagagagaaggagcacagcctgttggtatgaggctgaaggacttttataaacagggagagccactatttaattttaagatgtttgcattgctccaatctaaatcctcctccatagtctttatctaagaacatctgctacacacttacatgtcttggtgagacatttggaggaaaatcagggaaacagggttgagtttcatggttgggttggcatatagctgaaaagaatagaaaccaacaggagggaggtttgagggagattcagaattcaatgacagctggaatttatagccagaagcaacctagagaacagaatctctggggatttggtagcaatttccagaaggacaggactgggtaaagtcagctgacatgtggcttacatacgtcattgtaaggagaaataagtagaggacgacatgcacaaacaatctgatgtaacccagatccaatgagcaattaattccaactcagaggttaatacaatctttacagtgaaggaggaatttaaactatgctgaaaaattctgaaaggggaaagcagtgcctagttgtaggaggagaagagaagtaaggaaatgaagtgaaggaactacaggatgagcttatccttatatggctaaaatatactaaatgtcagggagatagtgggggatgaagctggaatatctatagatagggctctgaattctgggcaaagtgtttggattttattctttagggtgtatgggaacaccagatatttgaaaatgtgtgaccagatcctcatagtggcagaaggaagggtggactgtaggatgatggcggtagcaaaaagggagaatcatccagaatgttggagatgggattctggtagtggtaggaaagtgaactagatgagttctaaggtcatcattattttcaaagctgttatagtagaaaattaaaaaagggttctatggtgtaacggttaattttatatatcatcttgactgggttaagagatgatgcccagggagctggtaaaacattatttgtgggtgtgtttgtcagagtgtttccagaagcagttagcatttggatcagtagaccaagtaaagaaaatacgccctgagtaaagagaatgtgggcgggcatcccccaattggttgatggactgcatagaacagaaaggtggaggaaaggcaaattattctttcttctggagtgagagctaggacatccatcttcgcatgctcttggatatcagagctctaggttcttgggcctttggactgtaggccttatagcactcgcccagccatctcctccaccatctgctgcccccctcatctcccagtcctgaggcctgcagattcaggcatagagttaagtatgccattggctcccccagtttttaggccttcagagtcaggctgaattacactacaagctttccttgttctccagcttgcagatggcacgtcatgggacttcctggcctctataacaacgtgagccaattcccatattaaattcccttttacatacctatatataaccaatgggttacatacagatataacctataacctgttggctataataatataaccaattggctgcatatagatatatgagggaattgaatatataacctattagttatgtatggatatataagagggaatctaatatgttaaattggctctgtttctctggagaactctaatacacgtagtattcgggaaacagagaaccaacactgactacctgtccccacaccaaggctccaatattgatcttcactcccacactgcctgctgactgcctcaccctgactcacaatggcttctgccttgaaactcctgcatgctgtcattcttcctgacagacttctatttccacctctttgttggtcatctttctgcagatgacccctcctttatcaccatcccctgctcaatcagattcttgacttttaaaattacataggaactttgttaactggggcctgcatagtctatgagctgccaaagacttacttcttagtcaaaaggaacataaagcaatgttggtggacaacctgggaagggtaaaatgacttagttttactttccttgcattctaaaggacctttgcttatattttgtagagatgatgaggtaggggaggtgacatggggaaaatcaatttcctcaaaaatggctgagaggggattataaatttaacaagggagagggaaggaactgcaccatcatcatcaccttcacgaatatatcagcttattaactgatcatggctatataccagacactttgcaaagcacatgagtacattatctcttccttattgcaaagaagataaagaatatccatgagttgggtattctagtgtccatttatacacaacaacactgaggggcataaagactaagtaacttgctacaattaattcaaatccaagtctgcctgatagactctgtgctatcctgccactcatacttctttgtagtcctcacaaagttttgtataaggtaggtgtttaatatgctctttatttatttaaagaagcatactacctacatactccattccttgaaatctatgcttcctgttttacttattccacaaattttgaagggaaaatgtttcacacagtagaaaccattaaaaaaaatgctgaacacataccaagcaaaatatctgaattagtttggtcctgtttattactggcctcaagtttaatgagctcaagttaatacaggtgaaaggccagggtgttacatgcagaagttaatgaaataccatagagctgctgagaaaacgattagcagccaaatgtgaatttaatatacttcatcttcaagaagcaatgccccatgggaggcatcttgctgggggaggtaatgtggcatattggaaacagcactcacttgggaattaggagatggggctctgatcttcactttgctgtcagctggttttgtgacctatggcagcctgatgactccctctgtgtctcagttttctcaccggtaacatgagggggtttgactacatgatctatgaggtccctcccagtgatatgatctgttttgttttcaaattcacaattagaattccttagggtttatgcctaggtggcatcacattgtctgtgaatgaaacatcagattgagtcataaattataactctttccatcctacttaactatagaacattctgagtctattaggctataacatatggatatcatggatcatgtttatcaaacttccaaggttggatgggttcataaactgttttagacttcattagtaaaaggtaaaactaaagatattgtagctattttacctcattactaaataatgaaatctgtatagaaaattaatagaactaaaaatatttttttaatgaaagctattataaatctgtatgaattgggaaattcatacagttcataactaacattacactgtaattatcttgacaaagtttgatgtctagttacaaactcatctgagacacactctatagaaaatcaaccacaaatattagaagtgaatataaatgataacaggcatgaaattactaaagaggtaagaataaaatatagatacacatgtggatgcatttggtacatattagagttttaggatttgggagaaaaaatagaaccttctactaaagcaatgcaatatgcagaatgatcattgatcttagaacgcagaaactagctgaatgacctggggcaagccacttgccctctgtaagcctcaattttcatctgtataaaacagaaataacaatgatcaccttgcccatttgttcttcaccacaactatttaaaataggaaaagcattaatagatgattaaaatacagacagctgttactattttgaaaactctaaagcattatagaaccaaagtattattacattgtgcataaatctcatttatgcacaatataataaataatgtaaagatgtgagtgctctgaattataaaaatgtcacagagtattaacaatacataaagaaagattttctcagcaacagtccttccagtgccttaggagtacttggatgaaataatttgcttttgaaacccaccttcaaaatgctactgctttcatggctaaatgttgcatagaatgtcaagggcaaaaaccaatgagggaaaatggaataaaaattgccttacacaatggaatggaagcaaaggaaaacagaaaaatgaggtgatgaggaaaatgggactgctataaatatggagtaaaaaagcatacaggattcaggctatatttggagcaagactaggttaatcaattttcttccatatttatgcaatatgatacctaatatcctcctatgcagaaacacctgttttaatcccttttacagcacaggacataaaatattacattttgatccatctaaaaccctatttagagttacagttcagagcatactggaatgaaatgatcatcattttgaaagtcaatttttagtagttctatgctaagcagcagatttatattggaaagaaaataaaaggaagtataagttttttaatataaaaaatatctttctaatataattaattagcatacatgtatgaaatattaaacatgggaaaatatattttatacatttggcagagtgctccacaaataatagcttctccatgcagctacagaatacagtaacaaacatccataaatcagaattcatctcaaatctaggtctcccaactccaagcctagtgccactccctctacattggccatgaacttcctgaagtttttgggctactgttttgcccaacaatacttaaagtttttggtgttttaggaaaagatactgagggaaggacctaataaactacatccttgggaaagactccttctttcagatgtatttgttgagtatttacaatttgtctagtacatgctatgcgctgaccattgaagacataatggagaataaaacagatatgatctccttcctcagggaatatgtaatcacttttagtgcaatagaattaaacataaacaatcccactcacctgcactttcaccctctgtcttctcttccactactaagagaggtatcctatgtcctttaaaagactccactcatggactccacctcacgtaccctgtgatcatctgaaggaatttgcttctgtcatttttatctttgactattcaacaattcaccctcatttttacattattttcattagcacacagatatactttagcgtctgtcatcctaaaaacaaatatgctaagcataacaaaacaatttctgtgaccctacagccactttcaggcatcattaatttacttcccttcaaacttcttttaagcatttttaatagtgtctgtcttcacaccttcacctcctattcactcctcaacatatccttttcaggaatttgtcctccattccaaacaattgaaatgcttccataatgaagctaacaacaatctttattgtgcaaatcctgtggccacatttttgtttgtgctcatctaactttatctctcagcatcattaaacttagttgacccttctttctttcttaaaacactatcctatggctgggcacagtgatttattcctgtaatcccagcacttcataggctgaggcgggaggataacttgagcctaggggtttgagaccagcctgggcaacatagagagaccccatctctatttaaaaaaaataaacaaaacccccactattctgtttttcatcctacgtcacttctaagtgtctcctttgctgggtagtacatacaccccaaatctctctacttttcaccatttccattgatatggctctagtccaaggctcaattgcctcatccttgggctactgcaatagcctcctaaccaatctacctgctttctcttttgacttggtataacgtatcctccttatagtagcctgagaagttgtcttaaatagaaactatgacagatgattcctctgcttaaaatccttcaatgatttcattgctcttagaataaaattggaaaacatcaccatgactgtaggtttatctggcccctgcccacctcttcaatatattttaaccactgtcccctttattcactacactccagccatattgttcttgctattcttgacaagtcttataagatcatatgaccttagggcctttacatttactgggtttttttttttggtctgcatccagatctttgcatagttggatccttcacatgttttaggactcagataaaatgtcacctcctcagagaggcactctcggaccacccaatctagagtaggcctttcaaatcacactcttcacatctcctttttaaaaatattcacatcgtttatttgcttacttttaaaaatctccaacccctctaaaaggtactagattaaaatgttcactaatcttatttactaatttccagaaccttgagcaatgcctggctcattgcacactcttgaatgaatgaaggtactgggtaattgtacatttatacacagtacagtcttgaacttagcttggcttccaattctggctccatttttactaggtttttgacttagtcgtgttttacttaacttttgtaagatctcagtttcctcactcataaaatgggaataatattttataaggttgtaaagattatataatttatataaattgtatagagtgaagccagagcttcatacacaataggcacttaataggcctctttgccatcattatagaaattcttatcatcaacattatttttattatagaaattctagcaatgtctcatagctttttattaactttgtgaattacttatgtacacagtgacactatattaatgtatttattttttaaaaatgtgcttttaaaatattttgccttgtgcttaatattacgatatagtaaacatttcccatcccttcagcaaaccatttctccagcatttataagggaagtcaatggattaagcatgttgtacgtgatggagaactgcttatttcacatttagactgcatacactgtataaagtcaggattgctcatacagttatgtaattttgtgctccacatgtttaaataagtaaaattaagaaaatgaagatttgatagttgacaagtaaatgtaaacactagtgcttaaagaatgaaagcaagaccattctgtagcctaaactagatgctgtcatctgtgggggttagggaagatgctaagatctgagcctgctaccatgctacttcacgaacatctggcagtgtgtcacttcacaggcaacaacatcttctctaaacagaagagacttgaattcatcagggattcctgtagtacagtatatgcttaagttaagtacctgctttcccgtgatttccatagattatcatattcatgacactgtggagtgaaagcattcttctcactctctaactagaacatgaaaaagaaattaaaacattggcaggcactttgtctccagtttgttggacaagtaagaaaaggactttccatccattaatgtaaatgaaattcggtcaacttagagcatttaaacaaagatgacatcagcctgtctattaataaattcttgacaggataacaattacatttgtagttgactgtttttctttcaataaatgtaggtcagtgggtatttttaaggaatgtatttaaaataaattcgcaaaccccaataacttttctcctcatctctgttaacccagaaagtaactttaacatgcacattcttgcttcttaagagtggttttcagaacattgtggtcaaagcctttttaacacatgtgactgtgtaattaaatatgtgtgtgcctactgtgcatatacacacatatacatacaatgcatatccataatacatatatggtatctatattctaccccaatattttgaactgaatcctatagaaagatttaaagctacagcgggctctctgttatctagggatggtttttccatttagggataatctgggcccttgtgttactgcttctttctgacttgtgcatttctttcattattgactatcagaaaggaaaggtaagaaaaggtaataaattgatctagctggttagtcctctagccttaggaatccatttcgtagaggaagaagaagtgaatttaatgaataaattgagtttggggggattatgtgtggaattcactaatctacctggcccaataccccattagttagatttgagaaagtaagtttctaaacagaatcaggatgagattttcaatttcattttgtggaacgtctttccaagacaatgtgttttctttgtctaggggagttttggagatggtatatgttgatatatttgaatatcagttataagtactaccaaaacagtgaataattttaccttcatttattacaaattaaaagcacagctctatatttcatcacatttaagatgctatcatacattgtttattaatacaataaacaagaaaatataaggaaaatatgttgtttaaaatattactaaaactttttcacattcagcatctggtaacttgacgatataatcaattgtaagacaaactgattcagaggtattaaaaatgaaaaaatgcatgtcttagatttggtaaaatgcattgtgttttctaaatacttactggctcagttctaagtctccttctcatcattgttagtagccataatacagtaatggcatctcattactcctagggcgatgctacatggaaattacatcatcattcctaaaaccctatttatgaatgaaagtccacattttggattataaaacttcaaaatttgccatcatagaaaagcaaagaataaaccttgttctacttccagcattatcccagaaaacgatgagtgactatcacaaagaaagagaggtgagggtggacattaccgtatgttcttgagtcgggttaagtccatacctgaaaacttctgagacaggtgtctttattgtttcttgactccattttcctatccatatctcttctactcttctagaggtatgtggtgctaaagaattttttaggttaaagactatgtacattatatatttgtatttgtgtcttctaatgtgaattcaaggagaaaatagcataagcaatatttgttccttcaaagaaactcaggatgtcctaaccattttataagagaatgatttccctcttgtatttctccatgaatgtctttgcatgagttaaatatttgaaaggttgacagacttagttatttctagaagaagtttctgttgatcagtgtgcaggggttaattctggcactgccccttagagatatttttctagggcagaatgagccacaaagagaaagatacacaggacagtgtcaatacagcatcactacgtcatttaatggctgatggtggttatggcagccaatagtctgaggaaagcagattttccctgaatgatgaaaaaaaacccatcatattcaataaaatcacaaacaaataccatatattcctgttaaccatccaatgatgaaactgtatatgtgaatacactaatgcattccttaaatgcaaattactgctaaatttctaagtaaactgtcttccacttcagagccattgtaatccatctcttatgtcagatgaactgtgagacttatccttctgatcgcataggatttactgctttttgtcattcatctctcacacttggtaatccttttacctcttccttccaagtttgtaatttaaatgcactctattcacaactgaaaaaaggaccatagtgtaaataggatgtctttaagttacggccaaagaagtcattactgcttatacaatggtgtgggttctattacacagaggacaatatgaggaggctcactcttcacttgctttcatcaatgttttgtgtcaacacacagaataaagggtgggtgctgaatttggggtcttcccttgctttgacttgtttcttatggtattgcaacattttgtgtttgagagaaaagtccttgactaccagcattggcccccatgagttcttcagtttgtcatcaacatggattctgattttattgtttgaaagttctaaaatagcaaattgacaaaattggtatttactcctgaaaatcctacgtggccatttcaaagagaagcacgtttagaagaattaaaaggtgcatgtaaaatgcttccataatatatttttaagtgaaagagaaagcaggattacagcagcacatacagtatgatcctaatatagtttttattatacttatgtattttcctaattttctacagtgagcacacactacttttataatgaggaaaatgttcttaaaagtattgtcttaaaagtcacactaacagaaatggttataaaaacctatgcaggaagaaaattacaatcattattatggtcacaattgttaccttatatgtttttaaaatatgaatctcaaatcgtaatttagaatggtagatatcaaagaaatgtatgctgtgggaggatgcatatgtaatgactacacagatggaaatatgataagtagacctgaggcccacttctaaaatatggttaaatacataataagtaagaaatgctcattcagttcagcaaagcactgcatatgtttgaggatatagattttttttattcctgagaatatgaaactcctacattttaggtctatatggggtgttggcaaattaatatcctccaagaattaaactgtgatgctaactttccaagaattaaaactataatgttagcttttattagagtgagttcttttctatttgcagctctcaaagaagaaatacatttaggaggatatacatatgagaatatttatatacaaaaacacagattaaaagtttgtcttcccaaataagttaaacatttaacttaaaccaatgtttgctgagcacctacaattttttaggtattgatccctctagctggctccctattcaatgagcacacccaaactgcctgcaccacgactgccttttaacgggggggctatagtgcatcttaccaagacacaagcttaggaggtccagatataaactatagctgatgtaaaatgacaaattggtcatgcacagtggcacacacctatagtcccagaacttcggggggccaaggaaggcagattacttgagcccaggagttgaaaaccagcctgggcaacatggtgaaacctgtctctacaaaaaatacaaaacttagctgggtgtggtggcatgcacctgtagttccagctactcggaaggctgaggtggaaggattgcttgagcccaggaggtcaaggctgcagggagccaggattgtgtcactgcaccccagcctgggcagcagaggaagaccctgtctcaaaataaataaataaataaaagatacaaatatataaatatacaaataaaatgacaaatcatggatttactatggaaatgggtagtttttctcacaggattaatttttgtacacaatctcctttctgcagtgttttatatacagataaatttgagttgtctttagatatctacctcagaaaatgctcaaaaaggcaactccaggccagtgactcacacctgtaattctagcacttcgggaggccgaggtgggtggatcacctgaggtcaggagttcgagaccagcctagccaacatggcgaaaccccatgtctactaaaaatacaaaaaaaaaaaaaaaaaaaattagccaggcatagtggtgtgtatctgtaatcccagctactcaggaggctgaggtaagagaatcgcttgaaccctggaggcagaggttgcagtgagcagagatcacaccactgcattccagcctggacaacagagcaggactccataaaaaaaaaatgcaactccagacccctggaataaaagcatatgacaggttgaatgtgctaacactacaaagtttccaaaataaaatctttattgattgattgactgaatgccttgtaattatcaagtgtcgctcatttatctgctgctttcaactatatgtgaacgtatggatgaagaaagacttcctgaacaatcttcactagaagatcgtttcagaaccatatgctaaagcaaagcttttttattgctatataactgcagaggacatttacaggaagctgggtcaagcactcttatcatgtttcttatgtactaattcaacctatttcctaaggtttacccacattcattctataaagttaatacagagacaattaggagaaagacaatccattgtatacatattgcaagaaacttttagtgtcgctagaatgtcgaagatgcaatttatcatactttctttagaacttttgcatctttattcataagtgaaaatggtctataattttggtctacaattttctgggttgtactattgtcaggatttagtattaaagttggtcaaggttcataaatttattagggagttttctgtacctttctataagttgtaattgttgaaataacatagaaactctgataaaacaattagctagtcagatgtgaaatcacttgtgcctgatatctttttaataataaattttaaaatttgcttccaattctatggatgattattgactacataatcaattttagtagtttttatttgacaagaaattactcctctctctagattttctgaccaaataattatatataacaccttttcactatttaattctctcctgcgtttgaggtaacagtagagaattaaaggattctgttttcattcttatagaatacatttttgcttcctttttgcttgagatttcattgtaattgtatatatctattgatcttttcttttcaaatgtcaccttttgttttatttttccttttctttcggttcttcctaagactgaccttgctgatgcaagggggaagtgacatcccttagaggccagcacatcgtctcccagtccaggcgggtcttccacccagactctgggcaccctgagctctcttgataatcttcagattttattgtgataacaccttctttttcccccttttgtttcccaccctgtcgttaaccttctgcttaaactctctttccatttctctttctttttaacatttttttttctaagccagaaacttttccaacatacaaagccatttaaaaacacacaggtagaaagcaagagataactataaagtagattccatgcttcctggcttctgcatggggcaggaactgaggagggcatcaaaaaaacatggttcaacaatataagctgcattgctgtttaagtgcctggaaacagcagtgcccattgaagagtactgaacgtggaatcaatactcaataaggagattcaggttctagggctttgttttaaatattttttctgccagattcaaaaattaactcttatctaaggaatcagtcaccaaatttcccttttactgtcgactcagaagtttagataactacatagaaccaaatggaagaaaaatattctaagttttataatcacatttatttgcttcaaaactttcaaaaaacttgtttgtttgtctttaataactcacattttggtggtttagcgcatatcatctgaggattgatgttgaatgagtaaattactgtgccagttgcaaacaggaaagaaaaaaaataatggaagaggatacaataatataataatatttagtgacaacgggagaaaatccctcattttttttcacagactttggggacagaaggttctttccttcaggtattgggaattttgaacaacaagcattcattagaaagcatactaagtgtgtgatttattgtgacttccagtgacataacagagctcaaacagaacaatatttatttgaaaaaaaagccatatggcagtgcattctataattctggcttatgaacattgagaagtgaatttttaggccatctacaatgggtctcagcactttagtatgtctccagaagtcaggtaacagctctccatgctagaaaaccattcaaagcaatgacatggaaattagcacacgagtgtcccgctttgcagcccagtcccttgatttctgtgatttgacaggaagatgatatcaaagactgcagaaaagtgttaagggacagctcaaatgctggtgtgtgtgtgtggtggagcaggtgagcagttaggattgtgtgtcatgggctgacaggagagggagtgtcaggctaccacgtgggtgaacatgggccctatcatagaaaatatgctttttgttaggattctcaatatctagaaggaggggcaacctttctggcatgaatgtgcaactgctgtgaggatccagtaaaaggtcttctcaggatttgtttaaaaaggtcagctcaggaactactgacccctctgacttcatcctgacagtttcagccctctcacaaaatcactcttgtcacttctagcctcctgtgcttttctgaaaacaaaaccctctaccacctgccatccattattccaccagcaagcaacatgcgctctcttcagctgatatttcaatttattcgtggttagatgtgcagtaatcctctgactgaagctgagggagcagtttaaagatttaaaacaaaacaaagccagtgcttcaaacatctcttcatgcaaagcttaccagatgcagaaatgtggctaattctcatccacacaaaagctaaacgaagacccgcagatggtcagtgcctgccctctgcagagggagaggcagggttggctccaagtaacaaataattatccaggccctttgtaaatcaagttgtaccacttctcctgtgagcatccacaaagacggctgcatatatttgctattagctccttctttgtctggggattttgttaatgccctttcttcatataagtttgtgtcgccttgttctcacatttgacaccaactgaaatagccttgcagaacctttgtttctattttcttcaaaatgtgtattcctcaatgaggtttcatcttaatctcttcttttcaaaaggatatgaattgaacatgcagagaatcagcctaacaggaccgattatcaatttccatttcctttcagcgcctttgccacccatgggccacctagacagctttccttgaagacaaagggtgtctgaaatggacaactttattttatataccagtctcttagcggacgacagagcctcatcgccagtaataaatccttctcctgacccttttatataatgcacagctgagctaaaaaggaaatcaatgttgcaattttaatttagcactttcattctgttaatttatctaaaaaatcctatgccacgactttaccttgtcaaaacagccaatttgtgtcaataggaaaatgtgaaaatgctctgagtctctcctctgcacccccaaccacgtttttagtagtatggctgtaaaaaccatggggcacatactaagccctccatgttttcctgtaagtacaaagcttcttttgcaaatggtgtgagctcagcaagttgaagaaatatggagggtctttagcgagaaaataatctgggaccacagtgttagttagctttgctaaagatgtttgtgaaactactaaaatggaatgccaagtgtctaagtatgtattaatggtgatgcctgagcatattagtcaactagggatattaaatcttgattaatctctggggagagttctaagtaataaataacactgtgttttctgtcaggggatcataaaataactctggttttactcttttctctctgtatttcacaactctagaataagccagggatagaaacttaatttactctgggaatgatgctgccacaggagaatgaggtcaactccacaccacactgcactagtgccatggtggagatgcagaggggtggagcccctgagcaggtgaggacctgctacctttccagtaggaatcttgtgtcaagaaattgtttcttcaagcctttattcaaatatcacattctcagtgggaactttcctaatcatcccattgacattaaaattcttccctgcctcctgccactcattggccttcactatatcccttccatgactttttcccctcttggcacttctgactttcaatatcactttataatttacttattttattatctatccccattccaatgatatgtaagtatactgctgtttactaaataatcctcagggtatgggactgtttttaacatactgcaggtgctcaaaaacatgtttcccaaagaattatcatgaggtcacttctggccagttgtttcttgggtgcaggaatggctgcattatataggttgatgcatgtaacaactctgttggaaagaaaaccacctcttgctttcagggtgcttttgaactctacaagagctgaacttggtacgggagaaggagccaaactccaaatccagggtaaggaattagcccaaaggtgggcttataaacagagtcagatcctgggacttatgtgtggctgaaataaaaaataaacctagttggtttgggctcgaaaaaaggcttcagctattagtccagcatgctgtaagcaaagtaattcaatgagggccattatagcataggtaccatgcttggcactgtaagacagacaacatcctggcctgggtctgcaagtagattatgatctagggaagtttacatacatgtttcagtctagagcagggcatggaatgtattatcatgggaaatcaaggagggtttgtccaagattcttgaatcttgaaggatggaaatgttttcagtaccagagatgagataaatggcattcaaggcaatgagaatgctgttaagggaagcagaatgcatttgaggagtagcaattagcctcatgtagcctacttcctttgtagatgtttgctggagtacggatgaaaagagagataattctagaaagataggtgactatcatatagaggctgggttttacatgttgtattattttattgggtaaccaggaatagctcttaaagaggagacagacttcattcagaagcctgtgctgtaggaaggatgctctattttggttttgtggcagtgatggggctagggataaatatgcttagtcaagtaaataagtatttagaagtactaggctataaagcttaagaactatggaatctatccaacttataactgtaaagcagtaaatgtagaatattctagaataaagagtcatacacttacatttcaaagacttcccatcagagactttgcaattttgctccttattctttctagtattcttaatctgaatggttaagaattcttcaaatgaaatctctttaacttaattataaccaatttcatcttatttcctcatatatgtacgcagataattaccacatggcattgcgaaaagtcagcctgttacatgcctgatgatactaagcaagtctactgttctttaaaaaaatgttgctttaatctttccttatatcacttactctatcccttcagttaaaaaaagaaactcttctctttactccttgctatctttatttttttttcctgaatattgacaataaaactgtatgtggacctgagaagaatgtgactactggagagactagtggatgatcatttcttgactcttttatgcaattgactttttagttctcaattgcactgctctgattagtcaaattaaatataaggttgcctatactctcagatatttttcttctatacttggatctcgttagatcagaccatcctctattatctttaaagtaaaggttaactaccatgtggccagggaatagtaaaacatgatgctgacacatttatttcagttttaaaggaaaaacctcagttttcagctgatgaaacataggctgaaaatcctaatgctaaccataacattgtaggttctcatttgaattccaaaaattgggtatctttacatagaagaaacatatttactctatatgtcggtcagtactaagatatacacacaaacagtttaccacacttcctgtagacaaaatttatttttttctaataaactctgcttctaacattaaggttaaatttaactagttcattgagactttgttctttattgtcctctgaaattggtattatgctatcaaataaatataagaaaaacagtaaaaattcatctgagtagggtttgaaatatagtaccttcaatagcccagaggactcacttacttttgaatctgataaacaaagtaaatatatgaagaaaaatatatatgctccttggcatcacatttatacactagcttatttacaaaatttttctttattggtcctttgaatgtaagaaaatccacaatctagatgcttaaaaaatggatgagaacatttattaagtaagaaaatatacatggacacatatatatgaatgcatatcaacatttacttttggttttaattctctcatttatctttcccaaatttattttatagtctatctaatctttaacagattttttgttgttgttgttagcttcattacaacatctgaaatatccaatttcctctatagttgctgctgtgtttcggcagacacctttattgagttatcagaggactgtgcaggttctgagccctgcagcatacagagtagcctgggtgattcaggtcaatgtgcaataatgaatctgggtccctgccaaatatggtctgccattgtgaagttctatctctctgcattttaaatcatgatggttttttgcatttcacttttccatggattttgcttcattaaacaactttggaaggagtattttgcactctcaatttttgcgtgaaagtcactgattaactggtgaatttatggtttgaaatgatgcaaggcctgatctgtaggaaccagaggaaaatttcctaatggacttcttcctgattttaccaaagcaaatgccctccacccccgccctgctctaaatagcacagatttctggtattttaatgtgtcattagtttgaccagacagattttagtccctaataaaataattctcctaactcttaggttatttatttcttaatactttgttgtgagataaggcagaaagacatgctaactgagctgcaatgcttcaacattatgactttagtaacttttctgagtaattttaaaaacatggagagctacagttacccaaaaaaacagttcaaggaaacaaaaggactagatttattccaagcacaggttcagtaggtcagtgtccacataataatctgtgctttgtattttccattatttcttttaacatgctttagtgtctacaaaggatgaaagaatatagactccattgtccacttggaatttaaccttcctatttggccagctactaggcacaaaatgtttgggttcagtggatataagtccactgaggaaagttagatgctactaaaattttcctgcatctttgcacaccccggatgatctatcccaccccaaatatttgtgcatccacacagtgaatagtttatctgatctcctcatagtgattttctggattacctttgctttatgaatttaagaaagtcacttacttctttttatctgctaaccaagaggttcataaatattctctaaaaacctgtgggctctaacatgggaagttagagagtacgtacttttcctagtgggtatgaaagaaaaactctaggttcaccctgaatagcatctggagggactgaattaatacagtaaaactgcaacttcaaaactctttttttagaatgttaatttaattttgaaacctttttaaaaggcttaaaggattctttttagataaactaacaagtggggaagaaataagccacttcttttgggaagttatcagtggtttcaggaccttgcagtggcaactggattttcagaaaagaagaaatattttaaaataatcccccatttttgactaagataagactgtttgcttgtgaatggagactcaacatgtataacatgtctcctatttatgtggatgaatcttgttttcaaaagactatcttgatcacatgagatcgtttttctcaacaaaaaaacagaaaaagtattacaccatagatgttctgatgcattttttctcactcatatccaacatctcatttgttatagaaaattaagtagatttgagtaaaaaggtataaaaaagaaattccagttttatgactttctagtacttataattattgtaactatgctgaatacttgcaaaggcctggagaatgagactcagtttactcaacaggccagaataagccagagaagcaattgctatggtctgactgtgtcctcccccaattcatatattgaaaccccaacctccaaagtgatggtagtaggaggtagggactttgggaagtgattaggtcatgagggtgaagtcctaaaaactgaaattaatgccttcataaaaaagatcttagaaagaccccttcctctttctaccatgtgaagttatagtgaaaagatggctgtttaggaaccagataataggccctcaccagacaccaaacctgctagcacctatattttggaataaatttctgtggtttataagcctgatttataatattttgacatagcagtctaaactactaagcaaaaaattatttttatatgaataggtacttttaagatagtttaaaatggttaattcggtttagtttagaaataatttatatcattcctttcttttgagatcattactggctaagtacaaaaagtaatttcaaaagtaaaacttttgagattaatagtacaatgataaacttcagccatgctcttgtctgacttgtcagaaattcccaatttttaaaaacaagtgagatttgctgtgcgtgtgaggctctttccagaactgctcttttggccctcattcttatggatgtggtattcagtggtgaatccaacctccacacatgagtatttgataaatttgctcaagtagaacttctagatgtatctgacacttgttcccatcctacttgttttttaattacctatagattataaggcatttttatatacatgttttattgaaagctctggatcttaacaaagcaagcacttgcttggatttgcctccctggcccctttctccacttgttcacactcaagcttgtaccaaatcaaattccttgcaggcccctaatgttccattacatatcatgcccctcagtctatgcacgtgcatgctgggtctcatatacccttcctccaacataatctaataggtgaatccttactatgtcctaggtcccaccttgatatggccttctccaggaagcactccctgatgacactcacttctatcacatctgagattaactcattcttagtatttactacactatactgagtacctgactttccctcaggcctaggacagaatcttgtaatattaatagcatgctgtctgtcacagacaactgttcaaatacattcgttgagtaaatgaacaggtgaatggtagctaaaacttcattttctctttagcgtgtcttttgcacatgatttccacatttcagtttttcttaaaattccctgggaacagcatcttgaaattttctcaaattttatattttctttaggacttttgtaccttgctctgcctgggcagtcctttattcattcaacaaatatttttgagttgtgtttatgtacaaagtactttacaaggttttctaaggaacccaaagataaatagtacttggatgttgctcacaaagggcttacagtctaattgaaaagggaagacaagtataaacgtagcaaatggcaagcttcatacaagggaagtgacacattcaattggaggataaggcaggccttcttggacacgaacaaggcctgacagcatatgcaaagtctggacattacagcataaagagaaaagacattccaagccgtgagatgatgtttgtgacaaagaggaaaacagaacatggaaactacagatcaaagcctgactggacctcagtgtttatgaagaagggtagcaatgctgatggtatgttgaaaagggagcctgggttggtccaggtaggggagggtcttggaagttacatttttgtaggcaaaggagactagtaaaagcttctgtgcagagttgtacatctctcattggctgactcttgcttcatcttcctacgcagcatttctgtacctaactcctttttctatgaagctacagaaacccctcgtatcccattccacctccttttcctattattttatgacattctaaataattctagaaattccaacttgaaggttgctagaaaggtattcatcaactcattttcccccatcctcattaagctctattacttacatcaggctcaaaatcccaacaattagtttctgcagtagtcccctactggcatctttccagtactaatttacttgctacagattatatatttttttagttattttgagacctttgacatcaacatttccatttctggagccatttccttgtcttacagctcctgtattgtttcttttttgaaacaccaactcatggctaaactccactgagcatcttcttggattatgggaagagtatattaaacagaggccattatcttccacacacggttccatgtactgcaataacaaaccatgtatgtattgctaatcttgcacagaccaagtacatagcagtcggcactcaataaatttgttgagtgcttaataaatgtgtgaatgaataagtgttggttcatgctggagtgcaggttcctcagtatcaagtattagtatttctattctgtatccttgaacactctcactgaaacaggcactaaataattctgattaaatgaatgcattaatcccttcagaaaaaggatgcctgcagaaaaatcccaaggaattgcaaacaagatgcaatgcaataagttttctcaccccaaaatatgtagagcatcatatatattatttaggctattacagaaacatacatattcttgagttctcatttactgatgcctggcatatatgctttcaataaagtatagccattgctgatttttttttaagcctgactcaaaggcttcatgtctttgaactaaacaagagttccgggtttttatgacttatacaaacaaacaagctgagtgtggttagagttatccgtgcctaatattttaattccattgttcaataattccaattcctttgcattagttttgctttagtatacccttataatactttcaaatatatctataaaactttacagcccttttccaatggcatatggtgtgtgttctgaagagaaacatgtttatgagctgaaagatgggaagaaaatgtaaaatgctcttacgggactcggggagggattgctgcctgcctgtgtagcaggaacactgcagtatatcaagactcttgcagactgaacagaagcccttctatttcaacaatgagcagaagtctggaattgtgctatgctaactttgatgctattagggtatttttgttttttgcttttttctctcctaaagattaaagtaaatatttcctgaaacaatatttgaatactgtatgttgtaggatagtatcaactgagatggagggaaggagagaaaagtagagtgtggatggaggagtgacaaaaaataccatttttctgtcctctcccactgaagcccacccaaactttgtccaagccggagcttgcaacattgttccttacagagcttatctgtagttattcttggaaacatgcaaatactcattctaaaaggtcctgctgtattcttttttttttttttttatggagtcttgctctgtcacccaggatggagtgcaatggcatgattttggatcactgcaacctccacctcccagttcaagagattctcctgcctcagccttgcaagtagctgggactacaggcacgtgccaccacacccagctaattttttgtattttttagtatagacagggtttcaccatgttggccaggctggtctcgaactcctaacctcaggtgatcctcctgccttggcctcccaaagtgctgggattacaggtgtgagccaccacacccggtcctgctgtattcttaaaatggtcatttgctgagtgctagattcaaattttcagttgcctcatatattccatcttggtcttccttgtcacgatcattgatatatagtaacacagctgcagagactagaaagcttcgtgtgacctctgacttctttgctgttgcccctagttggtcaccaagcacagtcattttcctctcccatctctctcactcactcttccccttcatttccgtggctcttccgcaggtttcaggcccttgaactgatctcacatggcctattccaatagtttcttagtcagtctcttttaatgctaggcttcctcactcaaattaccctctaacatgccaccacaagatggttatttcttttagaaagtctactgtcattgcatcctattgtagcatttttattctgctttttattatactttgcagttttaactcctgtttgcacccagtgactgtaaactgcatcttcatgtcatcttcaacatctccgttacccatttcacagtgtgttttaaatagactcaggattatctttacacagaatgttggttttgctcacgaggattctcctggtccataccctgacatttctaaatgtccagcctttcctgttgatattctattagaaggtaaaataaaaaggcactcactgcctttaaatagcaatacaggaaaatttcactgctactctcatgttgtccaccaccgagtcttgagcaaacatagatgtgaaaataaaatatttaaggagaatactttgaaggatccacttttctgaattctctaaattttatttctaggtgttctaaatttaagctagatctttagagatctggttagctggagagtcctttgcaaaattctttccatggttacgagtgagaaaagaaagtataaaatgctacattatggaacctgttgttgcatttgtatcagagatgtggttctagaacaaagtatcttctttgtatggacacatcagacatttcttgagggaatcctaccagaaggagatgctctttacctcttctattggtttatacctgtaggtcctgtggtctgcatgtgatctatatgtgattgctccactttttgcattagttactaggctgctcagagtattatttttaaactccctttattagggatatcatccctactactgataatatttagcttatgacttacatacacatagatactaactctattccatctccattttatctttttcactctaattcctaccatctgatcttttcctttcctttcctctcctctatccttttcttttttccttccttccttcctttccttccctccttccctctctccctctctctttctttctttcttcctttctttcttctttctcccttccttccttccttccttccttcctttccttccctccttccctctctccctctttctttctttcttcctttctttcttctttctccttccttccttccttccttccttccttccttccttccttccttccttctttcctccctccctccctcactccctccctccctctttctctctctctatctatctatctatctatctaacttctgcatgcccagttattacttaattactgaaaatcattatgacaagttttaagtatgaacagtgtttgggaataaatgaatatgctagtaagttctatttcctgtaaaggcagcactttacacatagaagatgctcaagaatttcctgattggattcccaaaatttcaaagcactaaaatatatcaaaaagaaaaaaaaaaggaacgctacaggtcagaggtaactagtcatttgaaataacctaaattggcttttggtcaaagttgagcacaacaatatggtactcatccttattggctttcatctattcttagtgagttatattccctaacttgaggtaaaaagtgaggtaatgtgtggtatttttccctgctataatcctcatacagaatatctgaaagagaatggtacttttcatgcatgtaataatacccaggcaccactatatcagctaactttgctagatagcagtcacaaaaaggccattaatatctctcttacctccacctgagaaaggttagtgctatgggatgtgcacaagaagaagatcaaagagcatgcattgctggtccctgctatatgtcagagcaagacaactgaaatacactgagaaggtcaagagcagtggaagctgaagagataactatttgtgtgtgtgtgtgaatgtttataggatctgaagaaacctgagcacaaacgtcagtcttcatgacctgatcacatatgactcaatacagaggtgaaatcaaggtgctcctactgaggagttcaaagtagagactccgaagaatgaagagtgcaatacgccaaggcatccaggtcctaacaggaagaaaatccatgaacaaaaccagcaatgaagaaaaaaagatcattcaaaatggaataattttagtttctagggttacctttttttgtatttttcacataacaaaaacttttttgtcacttattttcctttacttaaatgattttgaaatgaagacaaatggttgccagggtgcctacaatttaaaatatgtctgaaaaggtttctgtggcagtcccaattactgagctattaaaagtaaacacaactaaaaatttgaagaatatgcagaaagaagcctaggaaaatgttgattttgaaaaagcaaaaacaaaccacaaacatatttttaaaaacacacatacacaatgtaattcctttatgatcctcatcagactttcctacatctcagcattctttaggtcagtcagtcaaatcatcgctaaagctttcaccaacaggaacatcgttcctggcgttaatacttcagtgtaagaactgttactaataataaaattttatatactaagaattttttcctcaagtgatatacaaatgcctctacagataaatacaatgttgtatcttatcactaatctattctaccccacattcattaacatagctacggtacagtgtattgggttaggaaatgaatcagatggaggaaatcttcacagctccatatttctaatataaaataggaattgtgcataaacattttgtctttatatttttcaaatataacaataataactatagaacatttgacaaatggagaaatgtaaacaacaactactacataaatttagcactctaaaaattctatcataaattctatcattcttataggtccttcttccatctttttcatgtgcaaatcatcaagatgaaaaatgacttgcatatgtttgatcattttgcattttatcattaaaacacctgatccaataaatttactgtaatttaatcaattattttctatattgctcccaagtttttataatgactactatttcattagtaagcaatgatgaagagaacttctatatgcacattaaaatatattttggattatttacttagagttaattcaaatactttaaagaatttcttttccaaagagctgaacctatttctaaagtcatcaatatttatgacatcaacagtttcaaaccaatacttgatatttcttaatataacatgaatattattttttttgctccgttggtatgtgatgaaaaagtaaggccttagttttcctttcaattttttaaaaaactagttagcttgaacattttctaggttcttttttagatgtatttcttgttttgtaaactgactatagagtactaagatattttttaaaaaaatttagcttagccttttataaaataaaagcattaattctgccacacttattatatttttcccgaaatctgttgctagcctttttggatttgggttatatattacatacataaattttacaatttattaaagcagataaatatatttttggtcttctccttttttaattgctttctgatagtgataacatacaatggtatcatagctttattttattctactttttttatttgaaaaaataacttttttctctaacttatgcaggggaatctgcttgttagtgtctttttcctttttgttgcttttaaaaattgattacctatagaagcttggtaaatattcagttttattttcttctacatgtactttggtttgtttttatatctaactatctaatcctttgaaatttgttttggtatatggtatgagacacttttgatctttttcttctgtaattgctataccatatcacagagcacactgcaatttaaaaaatcctttcccattgttgtatgaaaacttctatgatacacattgacctattaggttacattttttatttaaaattatattgtaggcctggtgcggtggttcacacctgtaatctcagcactttgggaagctgaggtgggcagatcacttgaagtcaggagttcgagaccagcctggccaacatggtgaaatcccgtctctactaaaaatacaaaaaattagccaggtgttacggcatgcgcctgtagtcccagctactcaggaggctgaggtgggggaatcgctgaaacccgggaggtggaggttgcagtgagctgagatcacgccactgtactccagcctgggtcacagagccagactctgtttcaaaaaaaaaaaaaaaaatatatatatatatatatatatatatatatatatatatatatatatatatatattctaattatattaggtagagactgttaaggtgtaagtgtgagcagcaataataagctgataataatgtctttatcttttaggtaaagacttatggccaagctagggttttatatagctggctctaggctgaccataagttttcaaaaaatgggaagaacatcactttcaacatttaaattgagttattaatgtatttccatagcgaaaataaccctattaaacctgagtataaatatttgctttcctctgaaaaatgatcagattaaaataagccagaatttggtattctcacatcgtatgtatgagcatgagttctgaaacagattgcctgagtctagctctctggtctgctaccgacaggctggatagtttggcaaattatataccacctttgtatgctactttcctcatacgtgacaggatggtaataatagtcatgatttcttgcagttgtgataagaattaaatgaattgaattaacatttatgccattttaccaagtttggggaggaagaggaggaaacgtgtcaacaaaggcttccttaaagagggtgaccatttggttaaatcttaaaatatcagtagattttcactatttgaatgttctattttgacacgactttctgaagttggtggtggcccagttagcagagaatttttactacatacttttaaaggttcagcgcagctctgcagggccacgtgagatgttgcttcttattagtagccctcggcataatgatgaagtaagttaacgttgcctttgacacttaacctcctctcagtgaaaccaaggtatggatttgaaagtacctcagtgttgggagtttaaatagaaaaagatctgataaaataatttacgcaaaggtgaacagtacctagtgggttactctttccaggtggggtcttatatatatatattttttttatttaaaaagtgttttggagataattgatattttaaaaaatcagcctaaaagacagcttaatccaccatttttctgagtttccctaagcattaagtttggtcaccaagaagcaacgttcttagattttattagcttaggttcactcgagcatacttcttttgagttgatttagctaatccttagctttcactaaaaattgatatggtataggtatttgaaagacacttttgtatttttcacaaaaccccggctataggcattgtacagtaaattattaagtgttcattaaatatggatccatgtaacaaaattttcccaatatttactgccaggagcaaagtgttgtctcttaagacaaacctagacatccccttttatcagaccatgagagctataaaactcatgaatttctttagtttcttggctaccaataagtttacagcaaaacatgatgtcctgttttaataatatagcttatcttttgtttcccatacaagcacttcttgctttctaaataatttctgctgtgtcttaaattttaaaaattttattacctttaatgttttaaattggtaaactactttaaaagacatgtaggaacatgagtggaatagttgttgcctgtgttcctcatttgacccttactaaatattaatttttaaaaaatagtgtcttttttctttccaagtagatttcaaggttttatggtagaacaggatttcttgttttctatcctctatactcaccccacatgggtactcaatagctaaattgattgattgatagctgtcttttaaaagcagatgtctagacaggatttttaatgatggaccttgttaaaaaatgatggactaatagtggaaatactaggctgagagagtgtttctgttatttttcaaaattcctctacaatggactatggccattttctgcatgcaaggaagaacacagccaggatcaccgttctttaaatcagaaaggactttgatagagtccagttccctcagttcaaatgaggaaaccaaggcccgaggagttactatcattcccagaagtagcgagctgagtcaatataacgttaagactgaaatttaggcctccctgttgccagtctgatgttgtttgatgccaatccatttattcactttctgcttccacacaagaatgacttgcataattttaaaggttggaaatccagcatgatcctaaatcagagtctccattcataaaactctaagctttaaaaatgctaggaatcattacacaaataaaatcctgagcactcattgtgctatgctttgtgctaaacatgtttcttttttccatatagtcttcgcaatcaccctatgaggtcagtactgttattattcctgttttaaagacgagaaaatgagaggcatgtctcatgtttagcactgggattcagtggcactctcctacactgtgtggactgcctcgcgaatccagtcatgtatacacatgtgtgtgtttttccttttggacacgtaatgagattttttttcccatgccagactggggtatcttagtatctctctcatggaattctcaattcctacccacctaggtttttccctggaaacttcctgccatcaaagcaggaatgatatttagtgcttcagtattagaaggtcacaaattgtgctggaatccaagggagaatcacgtatttggatgaatcacgaacgaatagtctgaacttccccaaaaacactgtcagtaaaaataaggtgctgccattaaatgacacctttaaagaaggcaagaacgcaaatttatgacaagaagaaagaacttctgagccaaaatcagctagatcttttttgtttttttcaatgccatccttgacactggtaaagagtagtcagctaggtatttgtcgactagaaagaatcgttaaaatggacaactaaaaccatcatatttacaagtgacacaaatcagaaattgttggctaacaaatctccttattccatcactgtgatatttgctaaagctgaccacctattaatttttccagtggagcctaaggatatagcaaatgccaagtaaatagttcaatctgaaccaggtttattgttcatcggctggtgctgtggtactgtgccgtgcttgtgtcttttgttgctgtggaacagcaggccttccgggaatgctaagaatacagtgtcttcccagagctgattacaccagacacgggcctcaatgatgcatggaccagctaacacagtgccacacaaccccacaatgctttcagcatattcagtcatctgcctcggagagactgaaaatattactattgatttggcttggtgtttaatgtggttgttaaattttaaatccctgtacaatgaccaatactttgggtagtaatgtaattcttccaggtttatcatctctcttgaaacctgactatttagtacattgtgtagcattaaatttcagacaggggaataggttttaataacacaaacacttaataaaataactttccatgagctttctcataatggtattaacagggaaagacaatttctctcattgcgcttctctgcagacattctgtcggctctgtatctccatcagttttttcataatgtgctcttggcacacttactttaatattgctggtttgagagcactgtcttttttatccttgtcactaaatgtgatattttgagcactcaagatgcgctgcaagcaggcctaaagtatttatattgaaactacaatggcaaagcatgtaggatgatctacctctctgaaatgagcctttaggaaacaacttcatcttgggaacatctctggctacacaattgtaaaaatgggctgataattaaagtaccagggaacactccttccatattcactgtttataagcagagtggtcttggtgggtgcacaccttaacataaaggaagtaatacttacatcttgcttttgtcacaccgaggctgatatctccactaagtacacatccctaatccaagacgttagcaaacatatctcttatcagcagtacggctttcacaggcttttttcagtgtccaccaaccactttccattctggataaaggatgttagctaggtaagaggataagcacagttgtaatctggatattcaagctgacctaatggtagatgctggatgcacactgaacctggcctggcggaaacctgtttctatatgagaatggcatgtggaaacagggacagatggtggggtcagtaataaagaacttgtttgttgttgctgattggaggccatttcttctgccagcatgactccacagatttatcctggcattggtgaccaaggggagacaaacaatgttgttcaacaagcattctgaaagctaccatatggccagaaggaaatctctggagaatactaggatgtgctgtgttgtgctacactgtggtagtattgctcttaagcagtagggggcatggtgagttcatccggttagaagtataaatagaagtaactgaaaacagcaggaaatataatccggtgagcttgcgagctggtgagcagttgtgttgtgggctgcttttaagattatttgcttaataaactgcattagtttcattcttttgcatttttctcgcaaaaaatgttcataaaggttgggttctagggtgacaaagtgttgggaaattttgttgatttaaaaaacataaatatgaactaataagagagaagaattcatgttagtctagaagcttagttaattgggagtctctagaggagtcactcaagatagtgtttgctaattaaggcaatgcattttccagggatttggagaaggaagagctctcctctggctttctgtctgcttatgagttactgtgcagcaccagtgacgagctttcactgattccagtcacatgactgacttgggtagatgtattccaccctcataacaaaggcttgtgggtagtaaatattacctatcaaataaaacaccaaggtaattccagttaactcttttcaggaattctaaaattttgtcattgagtttggtcctttcgaaaaagaagtctgccagaattggatatttcttttttaagtttttggattagtaaatcttatccaaaatgtaaattaatttcctataatagctccaaattaagaattctacaattctgttgatcctattctgatcgatgccagattcggttcatcggtgatgaacaagtcagtcatggtgcctcagattccttccatctcatttctgatgctgtagctggatttctctaattataattggatcacgccagtgggatttttagaaaactgcaaagtgttttttgttcttctgagaaacaagttataaaaataaaaaaaaatttatgtattctgaaaatggcttcacaagatgaatcttttaaagaaaaatcaaaacattatgaaaaacctaataacactcataagtttagatatgcaaaagaaaatgaaacagtattaaaccccaagactgggttctattcatggatttaaaaaatcttggacctgtctttacaaaacttgagtttaaccaactgaagtatcattacatccttggttttaaacgtcattaccacactaccagatatttctagactgaaaagattttttatgtttacgaacaacagattaaaggcaaaggcagcattattgtaataggatgtcataagatgtttctcagtcttagatgaggccccaactatgaaaggaatgttggcaaatctccttctttctaaaggtggatcaggcaggacttggtgagatgtgattcaaatttactctgtaggtctgggatctttccctgtcacccatagctctaaggagaggcagagaagacactggagaaaagattatgtattgatagcccagaaaaagtgctgtaattttctctgctctctcctgtagaatgttctgtttccgctacctcaagccaagtgacagaagacactctaaatacaatcaagagtggggtacttgcccaaagaggcaactgacatttttttttttttttactctgggctacctatttgctacttggaaaaaatctgcctttatgggacacttgctgactgtagtgataccagtcttagcaacctgaacatggacatgcccctgggtgcttgggtgggtagctgtggagggttaaagtaaggaggctggtgtctgactactgctgagaaaggcctgtatgtcagaggttggttgtgagggttccctgatagtagggccagtagaggtgtttgcttatgatgacagagacaggagttttttttggggacactctggaaagctgctgcaatataactacattgaaagccctgccaaggagaggtaatcccagtagaaagagacttcaggggtgaaatgccgaagcataggaaatcataatgggcagagcagaaggtatcaccagggagacagaatgggaggctctgaagatcccacagaggtatcctttaagaaaaagagttggcacctgccctgattgcatcaatatcacaaccatgccataagagcactacacaatcatcttttagcctcatatgcttcatcctttcccagcacaatggaggaatcacaggtgacatggagaagtggagaagaaggatgggagagggaggcagaagataatcacagacgacctaagcatccggccttttctctactgatgctatagggcctagtgcaggttaaagcagagattgtttaaataagaggagagccacaagtttcctggctggactctttattatctgagggtgttctaatgtctggaagtgatcagaaaaactctgggattttatccatagccaagaagaggagcttagtgggttttaagagaataaagatgtttctggcttgttttgaaagtgcagctcatttggtacactataatactgttttttcccaataatcaagtaattaatttttgtgtgatgacatgaagccaaatgtaagtgtgagctgagtggatcatacgtctaatagatctgtaaacatgaggaggtagggaaagttcacttctgagtacatatcacatctgcaaaccttgtcatagtgatccaaaatggaatgggaagtactgaagatgtatagtgatctcgcttcatgtaggattgtgcttgcattttctaacacagtccctggcatataatggaagcttaataagtgtatgccagaccgaactgggaagctgggaagaccaagcgaggcacgaggtgcatagaaggtgactaacaggttcttgaattagaagggaactaagttagagcatgagcatggccactattcctctactctaccttacttacctccctgactttgtctcttattactccccctatctactctactccagacaccctactcttggctgatccttaaggcttttttactcgctattccttctgcctggaaatctcttctcacagacatccacgaggcttatttctcatttccttcacattttgctcatatgagactttctctaaaaggtccatactcactgctgtctaacctttaaaatgcaacctgtctcctgacttccatacttttgagctcccttgccttctccacccttcctgtttacatagcccttatcaccgaatatactatcatttattatctttactgtttgttcatttttatctcttttacttaaatataagttctacaagggtaggttccttttttaaatggataaatcccaagtgtctagaacagtggctgacacatggtaggaatttcagtcatcttagctgaatgaatggatggcaatagatgcccagaggcctctgtgtcgtgttaactggattccatttgaggcattacagaaccctccggggtcaggggaggagttactgactcctttgccaagtagccgcagtacatatccacagcctcctaccaaaatcagcattctgggtattctagaaccacacacgaaaactgcttaggaactctcaaatcaagtagcaggtcaaagaactcctttgattgactctttgttaggctgtttggagtaggatgtactaattagatttggaagcactcaaggtttatactttgagctttatccccatagaatgcagagagaatagaaatgtaaaccctagtaaaaattaaaataaattaacagaatcaatctagatagttcttcaagtcaacttgcactcaaagagtattgggccttttatggtgcaaataatcatattgtacattagggataagtaaatctatcttcagttagactttggcaagcatttctgcttttaaatgtgaaaagccaacttgaaaattctgacaaatatattttatagaaaacttcatgtaacattagaaaagaaaaagaaactagtttccttcatatggttctactacacatatagaattataaatacatgcgaatctctctttttctcaaggaccaaagaagagaaatgaaaagaaaaacaagaaaaaagaaacaaaagattccagagatgttgtcagtctctttcaaacagctcattctttggaaagcatatctccgtcagatttcattcttcatacttgtttcactttccttcatcagtagtagacttaaaacactgttactctctttataaaactttacataataatctgttatttttttttacagaaaaatagcaattcctcctcagccattctttgttggctaaactaatttaatttattctgtaagctaaataatgccagctctttatgcccttcctgactttcctgcttggcacttgaatagtcttgattcttttaaatttggttcttctaagattttctgatgaaatttgatgaaatattttgatgaaatatttgatcaataattctttagagacttatagaaaactttcaaaagctattgctttcatttttagtttttctcagtataaaatacatgttccttaaagaaaactgaggaaatatagaaaagaaaaagaaagaaaaattaccaagaatttctgctttcagaaatgtctggtaatatatgggtattatcatagcttttttttcctgtccacaaatgcatgctttttttaaataacaaaaacaggaattatatttagatatagcaaggtttcttgtttttttaacttaataacatgagcatttctaagggccataatatactatttttaatattattatgattattttgaaaataagtcactttcattctaccagggatgtttggaacaaggtgtgttttggaattccttcttgctagaatggctatattggaatcctgtagggcatcttgacatctgctttaggcacactgaaatgttcaatggcaagagtatttaggactgagaacatctgaccactcagagcaaattatttgaacttctaagtgaattaacccacaaaaatgacttgataaccactatctaatgctgattgagatatcgaaaccacttgtccacaggtggaaagagcctccaagataagtgaatctagattcctgagtaaggaaatttagtattacccagtgactgtaccaattagatagacccttctacctacagactcagtgtcaacctctataaaatagtaaatataatcctcacctcttttcacacaggagtttcttagaatttaagtttggcaaacactataaaaaatagctctgagtcacaagaaattgccatattgccaggctacttagctatttattacctcacacttttagtgtctgaggtgagtcaactttaaacaaaaaagcattttgaaaatggattttacagcccatcttcgtaaggccatttcttatatctcatctttcaaatttcatttgaccagaatttgggcaaagagaattattcttaatacatttgtaacggctgcttttatgtgtcatcaagaagagttgttcaccagccaatggtaactgactcttctgactctttatccccagttacagaccttccgaacaaggaaattattattcttgccatgattctctggtcatcaaaccctgctatgcatcaccatgaaacaaatatcaaataaaggataagtctcaggaaaaccccagaactggatttcaatgctcagatcctgaaaaagtattctctgattttaagacatttgctgattcaagtgactttttaaagcaaaaagacaacaaatgggtacgcttccttaatgcagagacataggcaaatgcctttctttcagctttacgcaaagatagaagaagaatctcttacattctgggcaaccatctggaactctattaattggtgtatgaagcaagctaaactataagctcagatgtaacatgaaacaaatatactcaattaatggaaggtaaaattacagtccccaaatggaaagaactacaagttctctggtcattctacacgaaaagttcattttgacatttcagttatattaacaatctgttcctgctttggtggtctggaaagaatgaacagcaatattcataatctctactatcaactttgctaaattttttccccaaagaccatctttattaccctgtaactttcactacttgaagtgttcccatttctacaataaatagattaaaatcaacagagaaaagcttcaaaaagtgacagggttgttggaatttttcttgggattgttatgactccttctttatacacaggtcatctgagtcataatgaaacaccaactattcagagtcacatgctgtgctttgtgcttttggttgatcagaaaagcagtgaacttgatcccatcactataatctgatgcagcaaggaagagtgataacaattattcttagctgatttatttttttcttacaaatcactttcttatgcacacagaactgccaaaatggcatcagttctctcactaaatcttgcaaataaaacagtatacctttcaacgtggtggctgagattgtgtgatgtggagaaaaggaagatatgcagagatgttagcatggccacagggtgatggtggtggtggtgctggggcaagtgtgcactactaataggagaagatgtcaaaaaaaatgaagcataataatagtgcaatttatccttgctaaacgtactgcagtgtgctataattaaatatgaaaacctaaatttatctctatgttcggttgtcattaatttaacagggagtgcacatgttctaatctaatggttgattttttttctccatgtgcagcatattaaaatgtatattagcctcaaggtgcataaacacaaaataatagaccaaaggttttggcctgtggagaaaaaaaatccatgctcaaaggccgtcaagtagctgtgatgcaggggagacactcacttagcctcattaagccaaagctctcttttgcttgtcttttgttctgcatgacagcagcctctttgttgtataataattcattccaagttcgttccaagctaccgaaactggtgaactgtggccattttaatgagaagtattggtggtatgcataatctggaagccacgtgggccagacaatcacagagcactgcagccagcaaaatgagatattgtcgaaatcacaaatttgtcaagttgtttttggacagggtattataataagcactaaaatatgcatcctattactctgcatctgccagtcaaagatcactgtaatgaatgcgtgctgcagggtataaccaggccgttttcctaagtaaaacaaaccacagagtacagaaaagaattgtgtgggtttttttttttttttttggcattgtttgacttttttttttttcctaatccttttgcaccaggagtcaggttctcctggcatggtgtccactgctagcagtgaatacacaggccctgctggtgccagggagttaacatgaatacattgcttttttaataggtgtgcttaccatctgagaatacaaaacctcaaactcaaggcttcaattgagtctactgaagaattcctgggagagaaaagggaaaaaggaggagaaaaaaatatctctcccaatgatcctaagccttatgttttatccttttctacttcaaatggcttagcctttgggacttgttttgttgtttgtttttctgtttgtttatttttgcttttttgtctgtctgttgatttatttgctttttagatgaacctaaagctttgggaagaaatgggtgagatgctaatctatcccagttctataatattaatagtttgtataagaaaactaatacaatgttgacaagtagagagagtattttcacttgcccataaaaatggtccttagggagagtgaccatatactttctcatctaaaccagaactcttttgagagtgaagggaagatattatcgataattacaggcacaaaaagcaagactgtcagagacaaactggcctatatgatcatcccaaccataagctcttgaattggcaaatgtaaaggaagcacaccatgtccaaaggccatacaatacatcctgttattctgggcagtctctatgaaacattcagggttatttgtttgtttgtttgtctgttctgttttcagccaatggactttccataaggtctggatggaaataaaatgattgttaaatctaagaatacggagaatactcttccattcttttctagccattttttaaaccttacggaaccttttttgtgtgtgtgatcaggaggcatgatgtgagacagagacatataaaagtatggtccatatggtatttataattggggctgcagtagaaagatgggtaaaaccaagtacaattactcaaataaatgtggatttggatggtaaatatgaatatatgtataaaatagatgctttcttagtttagaggagataaatatatccagtgggaaaaataaacaaagcttcctggggtaggtgagaattagtagaatttcaatggcaaggaaaataaagagtcagaagaactgcatgccatgagccaatgtattgaggctgttataggaaggaggagagcatgtttgaaaaccactttactgaaagataatttacatggaaggaagtaacaaaagtaagactgacaaaataggccaggtgcagtggctcacgcctgtaatcccagcactttgggaggccgaggccagtggaccatgaggtcaagagatggagaccatcctggccaacatggtgaaacgctgtctcttctgaaactacaaaaattagctgggcatgggggcatgctcgtagtcccagctactcaggaggctgaggcaggagaagaatcgcctgaactcaggaggcagagattgcagtgagctgagatcgcgccactgactccagcctggtgacagagtgagactctgtctcaaaaaacaaacaaacaaacaaacgaacaaacaaacaaaaaactggcaaaataggttgcagggagatcacaaacagccttgaatgccagatgaaagaatcccttacatttgttggtcaagaagtatcactgaatgctctgaatcagaaaataagctttggaaaaaataaactggcagtgatatgtaaagggtctggagaaggagaagctgggagaagaaagtctacagttatagcgcagaagagtggtcctaaaagcctaaaccaggatattgatatttgagataaagataagactatccaaaatgctccttccttttcctaaatatcccaactgtaagacttacacatatttctcaagttgtataaaatcttctcaatgtcctctacgtccttagcccatcagtccatcttattttcatgttaaactcttctgtgcatcatgtcaggctcagtgattgtggagcgagtaatagctctcttttactgtactttgagaatgggtagaatcaagagggtgagtgcaatattggtttatacaacttggtatagcctaagttggtaagcattttcttttaccctaagttacaaagtgtgtgcactttggatagatacatgactactttattgtagaggcacaggtttgagaagggagataagtgcaaggcaaaccagatccctgagtaggtctcgggagatataagctagaaactctgcccacagcctgaattatggaagcctgcaactgtaacaaatgtcctgggatgaaatgtctggagccttaagctgtcatgcatgacaagaacagctctttagtgccagaggtctctgtctctggggcactggtatatccctccattgcccatgtgttcttctgtttggtgtatgtgtagggtgtgtgtgtgtgtgtggggggggtgtgtgtgttcttttgggatatctgctttgaaatttcatcatcaaactaggcttttccctgatgaaagttccatactatagagaaaacatccacatttgcttgcagtttgtgcagcttaaactgaagacagatgtcttgtgcagcaaccacaatattttcatttatctcttaatagatttccatctaggaatcaaaagtctgattttatttttcaactctgatgatgaatactaagaattattttaattatagatctatttcattctgcaggaaataaggagaggcattttgaagtttttttctttaaagacctcaataatatttatcttctaaatgggattttcatacataccatgacaatcttatggattactacatattgggagatacctactatggaatccctggcaatatctagttttaattaaaatgaaatgtcataataatgtcatcccacattctggtgtcacgacaaacatctttgaactcctgtgattaaataagcagaaacacttgataaaacttctaatgattcttctaaagaaacgaaaaatcttacagttcattgtttgtatctcctttacaagtatatcctttcttgtattatagctatttagatcttaactttcaactcagttataagctcttaatagaaaatacctgcatcactctaagtttacaacagagtcttttgtacgctttgggcttgatagatattaatgaaatggaaaggtaaaggtaaatgtttcacgccctttggaattaatctctattgtacatacataacatgcagatgcactaacagaagatgacaaaaattagcaatcttttgaaaactagtatttactaaatggatgtaatatgtgttgattatcataagttaggattgagtaaacaattaaaatgctctacttggaccaaattgaaagcccatattactggcaatctgatacagaattatagctgtgtttcacttgtgaaatagagataactttttttatttttttgtaacagagtctcgctctgtcacccacgctggagtgcagtggcatgatcttggctcactgcaaactctgcctcctgggttcaagtggattctcctgcctcaacatcccaagtagctgggattacaggcatgcactgccacgcccagctaatttttgtatttttagtagagacagggtttcaccatgttggccaggctggcctcaaactcctgacctcaggtgatctgcccatctcagcctcccaaagtgctaggattacaagcctgactcaccgcgtccagctgataacttttgtctttctccagtgtcattatcctagtttataacatcatcttgcaactcgatttctatagtagacagtattagctacataatttggggacccaatgaaaagtaaaaatccaagcctcccagtttaaaaattattatgaatttcaagatggagttgtcagagcattaatccaagagcaggaccttctgagagggaagctttgtgctatggcacagattgcatacccacaaagccaattctgctaaccacctcataatgatgtctgtaacttcattgcatcacatttcctatatattttcacatagtaacattacgatgtatttgtatattttcaccatttctgtgtaaaaccatttggcagtttccctttgcacatttaataaaatccaaattctttgtcatggtcaacgagcctccacataatgtggccattgtcaacctttctaataccatgtggcgttacttcctctttttttctctaacttgtgccacaaaggccgtccttcaggtttttgcacaccttcacaaatgctactctcaccagtggaacgctgttccctggctcctcatccttcacatatcattccaaatatctctttctcacagaacgcttccctgatacccaaattaaagtagctccacattctctatttttcttctaagcatgccttttcctcctgcaaatgtttagtacacactgtatcttaaaaaaaaaaaactaaaatagtttctgtccatgattagcttgtaatctccaagagaacaaggaccagtctctcttcttcgctacagtatgacaatgtttagcacattgcctacttcacagtaggtgcttaataaacatttgctggatggatgaataaatgaatgaatgaaagcaccattcaaatgttcaagaacatttttctcactattactattattttcacgtaggtaaaatataatttgcttgggcaaccagaactataataagctcacccaggcattttcttgtgggcactgggctctctctgggttctcctctgaagaagccctcttctcagatatactgtatatatgaatatttatttctcttatacaaaagaggacctcagagctaggtacatcactgcatcatctgctttcatgacttctggatggagtgagacatgcttctttctaggtccttctcttttccattttctattttacttaaagagaaggagctgttaacatattgaaactaaccatcctgttcttctttagcttcaaatagaactaaggctgtttataagaaactacacacaaatagaatatattgcatcttcctggaattctagtacattataatgacaaatgtttttcattgcaatattcattgcattatgttcaattgtttttgttgttggtctggaaacaccagaagtgtaattactagctttgataaagtaataaagtcaatggaataaactatgcttggattatggcctcttgttataagataagcaaagctaagtcaatacccaataaaaattaatactgatatcaaatccagctatcttatgttcaaaatgagaaatcattaccttctcgtaacattcttctatgaaatgtgttccttttaaaacattaaaactgtagaaacattaaaatactttacatatatttacatataccttactgtatttgagaacatatatagagattatacagatataatcgtacatatatatgagctcttttgattctttacaacagtgctgtgaagtcaactgggaagactgaattatctccagtctctagatgagaaaatcaagaatcagaaagattatctggggctgggtgcagtggggctgggtgcagtggctcatgcctgtaatcccagcactttgggaggccgaggcaggcagatcacctgaggtcaggagttcgagaccaacctggtcaacatggtgaaatccccgtctctactaaaaatacaaaaattagccaggcatggtggtgggcgcctgtaatcccagctactcggcaggctgaggcaggacaatcgattgaacctgggaggcggaatttgcagtgagccgagattgtgccattgcactccagcctgggctacaagagtgaaagtctgtctcaaaaataaaaaaataaaaaaataaaaaaattaaaaaatgaaagaaaagaagagaaaaagaaagattatctggtactatgcaatcagctattaatacagacagaatccaaatcttcaaatccctgttctttcaattttactgttaatatgttccaaaatgcattttaaattaaaaacatactaatggtcatactctactattccatagaagaatttaaaaatggaaagttattcatggaacagttttgaagtagtatattatctgaatttgtctagtatattttattaagctctcttcagcctgtcctcatcaaaaataagtattacattaacattacagttatttaaaaattaaccttttctaggctggtttaattttatggataatgtattaatcaacatggcttgaagtttcctatcaaaatgcagtcaaggccatttacactactattttcaggaatctccttctgctacctttgtaaagcatttacttcataggaagcatttcaaacactactagtggaaaaatacactaggcaattatagccaaagtttctacggatgtggctaatttatttcctggtttaaaccatatctaaacgagatttaagagttcaagagctgggaatgaatggacaattgggttattttgtattctgtggagtgagatttgcagtcaatgtcagtattaaatctaggtgtaaaatgcaaaggtgcgaagtttgaatgatgcctccactttgttaggtgatggctgaatcacatacacacacacacacacacacacacacacacacttacataaacacattgaatatatacacaaatacatgcagatatagttaatatctataaatatatctattaaattataatattaatgtcacgtaaaaatacacagatacccatatttaataatttttaaaatataccatatatagtacttatatctattgtatataacatatatatgcaaggcacacatgtagatattgctgtatatattctgtagactaatatattgatatatataattatcatatttatacaatattatcatcatcaatgttttcatcaagttgtcactctctcaggtatagcatacctgagaactgaatacttttcaagtttatgtttagatggttttcatggttgcgttttcccactgataaagtagaattttaaatataacttgtcttatttttatctgtcctcaatttgagtgtgtcctagttcattaaatttagaaatcccttctcattgcccctctgccatgtagttaatggtctgtaaaacacttaaaaacactagaggagttcatttttttaaaaggggctctatggagaagccttctaaaatgtaagagtcttttgtaatcacctatttatttacttgtactttaagttctgattttcatctagtagaggcattctttggtcaaggcaaaactgcagtattctctgtagcttaatatgagtatagctgataacatcatacttttttccattactactatactgaaactagtctagaacctaatgagctgaattgctatccaaaggaacaggatttaggttcagatggggaaaaagagaataacagctgcatccacactcccttccacatgatcttgttcatgagcaatatgatgacctggcatgacgtgcaactttaggtctggctctatagccccaggagaacatggcgaggacagtattaaaaacgtgtctatcctattcaacaaatggtgctgggataattggcaagccacatgtagaagaaggaaactggatcttcatctctcaccttacacaaaaatcaactcaagatggatcaaagacttaaatctaagacctgaagccatataagttctagaaggtgacattaaaaaaaaccttctagacattggcttaggcaaagacttcatgaccaagcacccaaaagcaaatgcaacaaaaacaaagataatagatgagacttaattagactaaaaacttcctgtatagcaaaagaaataatcagcagagttaacagacaacccacagaatgggagaaaatcttcatgatctatacatccaacgaaggactaatgtccagaagctacaaagaactgaaacaaatcatcaagaaaaaaataaacaatcccatccaaaagtgggctaaggacatgaaaagacaattctgaaaacaaatggccaacaagcatatggaaaaatgctcagcatcattaattatcagggaaatgcaaatcaaaaccataacacaaaaccacctcactcctgcaagaatggccatgatcaaaaaaaaaaaaaaaagatgttggcgtggatatcgtgatgtgatgaaaagggaacacttttgcactgttggtaggaatgtaaactagtacaacgactatggaaaacagtgtgtagattccttaaagaactaaaagtagatctaccatttgatccagcaatcccactaatgggtatctacccagaagaaaagaagtcatcatacgaaaaagatacttgcacaaccatgtttatagcagcagaatttgcaattgcaaaaatacagagccagcccaaatgcccatcaatcaatgagtggataaagaaaacgtggtaaatatacatcatggaatactactcagccataaaaaggaatgaaataatggcatttgtagcaagccagatggaactgactattattctaagtgaaataattcaggaatggaaaaccaaacatcttatgttctcactgataattgggggctaagctatgatgatgcaaaggaataagaatgatacagtggggccaggcacagtggctcacgactgtaatcccagcactttgggaggttgaggtgggtacattactggaggccagggttgaagaccagcctggtcaacaggcgaaaccattagccatgttattagccaggcatagtagcgcactcctgtagtcccagctactgaggggttgatgttgcagtcagcaaagattgcgccactgccctcctgggcaacaaagtgagactccatctcaaaaaaaaaaaaaaaagattgatataatgtgggcttaggggaaggggtgagaggggggtgagggataaatgactacacgttgggtacacattggtaagtgtacactgcttgggtgatggacacaccaacatctcagaaatcaccactaaagaacttattcttgtaaccaaacaccacctgtcctcccaaaacctattgaaataaaaaataaattaaaaataaaaacaaaaacacgtgtctaggtagcatacatgataggtgtactcaccctaagtaagttaatgtgttttacttgtgtcattgcaaaaatgaagcaaggtagagctataaaggctgtctgaacttttctcaagacccggtggtggggtgaggagtcagttacaactggttatttcctctttgcagggaacgtatatgtggcctgaatagttgagcagacagacttgggcttgctgctattaaatatgtggaatgtgtgttaatattcaggacatattttttctatttgatttcactactatacttcaaatttcatgcctcctaaaatcaaaggcttttcacatttcatatttccaagtgttgtcataagtctgactttggaatcatcatttacactattcatagttcttttcatctatcaaatgttataacctgttgttccctggattctgtatgaaaccagagctcttctgcttttgtgtccaaatattctctctgaattttcactcgagtcattaaaaaagaactattatctgactcttccatgatttgtctctggataggaagccccaaattgcattagttgtttttattatcctaatacactgaaagcctgattttactataatttgttcttcactttcatcccagccctaggtctcctgataatactgctttctaaattgtgtctattaaatgccttatttgatattattatttcacagattcatatcttacatttacccaagtttcatttcatttcttctttcttctttgtaacctctttagattcttttgtgctagttatcttttttctgagaattgaaagtagttcccaaattatagccaactacaaatttccttagtgttcttttgatctcactttccaacggtctcactaaataagacagatgagatgcttcttacattgagattttattttattgtattatctgttctagtacttctcaaacttaaacctacatatcaatcacctggggatctttttaaaatgcagattgtgattccatagctgtggagttgggcctgagattctgcatttttcaacaacctctggtgatgatgctgatgttgctggtttgggtaccatgttgtgagtagcattgatctagataattccagttggtacaaataaataacttgattgatttcaaataatgttttaaataaaatgtttatatttttagtgatggaaaatttttaaatctgtagttatttgaaatgaataaattttttttaccttggattagagaatctcactttaataatacctaagaaggagacaggagcttgattttcccttctttagcctccagggttccattctgatagaaaaatacaaactgcattctttaaagaaactaccatcagagtaaacaggcaacctacaaaatgggagaaaattttcgcaacctactcatctgacaaagggctaatatccagaatctacaatgaactcaaacaaatttacaagaaaaaaacaaacaaccccatcaaaaagtgggcaaaggacatgaacagacacttctcaaaagaagacatttatgcagccaaaaagcacatgaaaaaatgctcaccatcactggccatcggagaaatgcaaatcaaaaccacaatgagataccatcccacaccagttagaatggcaatcattaaaaagtcagtaaacaacaggtgctggagaggatgtggacaaataggtacacttttacactgttggtgggactgtaaactagttcaaccactgtggaagtcagtgtggctattcctcagggacctagaactagaaataccatttgacccagccatcccattactgggtatatacccaaaggactataaatcatgctgctataaagacacatgcacacgtatgtttattgtggctctattcacaatagcaaagacttggaaccaacccaaatgtccaacaatgatagactggattaaaaaaatgtggcacatatacaccatggaatactatgcagccataaaaaatgatgagttcatgtcctttgtagggacatggatgaaattggaaatcatcattctcagtaaactatcgcaagaacaaaaaaccaaacaccgcatattctcactcataggtgggaattgaacaatgagaacacatggacacaggaaggggaacatcacactctggggactgttgtggggtggggggaggggggaggatagcattaggagatatacctaatgctaaatgacgagttaatgggtgcagcacaccagcatggcacatgtatacatatgtaactaacctgcacattgtgcacatgtaccctaaaacttaaagtataataataataaaataaaattaaaaaaaccccttcttggtaataagttatatcacctagtgtttgcacacactcatacacacatcaccttttctgcccatgcacacagttttagagatcccttttcagtgtattaccatcatcttgcctttttcttattgggaagacttatctacttatgtgggattttattcctcaaataagatgggttttattaccgacccctgaggaacacaaatgcccagttatccctatatggagtttcctattattaagtcagttctctatccaagacaacaaagtccttctcatttccatggtgactgaatggggaagcaatgattataaggcatcagccagaacatatgcgacagaaaaaaggaggcttgaaatttctctagactcaggaaatatgtattccatggcacacaatagagtattgcttctgaaatatttcaatttctgtggaatacaactcttgatggatatattttcaagttgtaccgacattcccatacctgtaatatgtgtataagctctcctttacttttgacacttttattcacccttaatggtacatggagctaaaagtgatatattttccagatgtggcttgatttcaggtgatatatatctgcaactaaagaataagattctttacaatgagcaatgctgaataggtacttctataataatcaggcatcacatatttggacttgactgcttagggtaaccatatatattcttgttgaagtactgggtgcttaaaaatgttttacttcattcctcagttaacaaaaatgaccctgaaaagtacactgatagcaagtagtattgcaccaattatacccttcactgcatttgattgtagggttttctctttattagcttaaaagtgagcagtaccaagtccaattccccagggctttttgtgcttctacaaatcatgtcaagttgctcacaaccagtgaattcattactctgatttagcgatggcagtacacaggatgggaatttaaaaacaacagcaaaaaacatttaagtcttcaaattttactagtttgcaatatgaaaaagttttatatctaggtgaatgctctttctagaaggattcttcatatttttatttatgatagatgatttttgaagatttcaacttctggtaatggcagaatacctcctttgggcttctcctgcagataactcaccagacacacacacacacacacacacacacacacacacacacacacacacacacactctatccaaatgcactgaagaatgtccaaaagagggcagaaactaaaggggaattggcacctggaagaagggaatgacactattctttttgcctgagaacaggctcagggggtggtaccaagcagggaggttaaaattcagagagaaattcgtcttctaactggctgagaaatcagagttggggccatcaaaacatctagaaactggggagatatccaagaaagaaagctacagagagggagcaccagattctgcatatgtattctacccaaatcactggctgacatctgagctatgcatgtgcttggcagatgccaagcagcacagctaagattgaaataactgtacagatatttcagtcagttgctaactgcagaaggggcagagttttggggtttgcattaagataagttaattgtctgctaaagcaaacaaaaatcgggactcttaggtgtggagagtccagagtctctgtataatgtatcatttacacagtccagatacaatataaaattgtcagacataggaaagagcattttgactgctctcaaaatgaagggcaatcaacagggatcagtcctgagatgatccagatattagaattagaggtcaaggattttaagtcagttattataactgtgctcagaatataaagtaaaatactctgataatgaatgatgagataataaatatggcaaagtaataaatgagaaaaatgaagcaaaaagaaattctagatttaaaagatgtgatactaaaataaaaagttcattaggtaggcttaacagcataatggagatggtatgagaggaaagactcagtgaacttgaacatggataaatagaaattgtccaatctgaaaaacagagaaactattaaaaaaattaaaagaacatctgggacttgtggaacaatctttgaagttctaatatatattcatttggagtctcagaaaagaggaagaaagaatgaaacagaaaaactatttagagaaataatgactaaatatttcctaaacttggtaaaaaaataaacccacaaaccatacatttaccagtttaagaaacccacagaagcttaaggtagataaataaaggtttctaacattttaataatatgtaggaagtaagttgcagaaactattcagggggcaattttgagactgaatttgtggtatgtttgtagaaaactgtagctaaggagatatgaaaaaatgggaaaataacaaaaattaattagaaatacattctgttccttttaatcttattattagaatgttaaataggaatattaaaggaataaatttatccattaaataacaaaacagacatatgattattcagttactatgccgctaaataaatcctatgatttcatcttcctcccttatctccctccttccttgtcttcttctctccctccttccctctctcctgtccttcttttcttttatcgtagagaaagatgaaggataaaatctttcttactgatactattatcattaggatacaatcatcattaggaagacatagtgttttactgtttgggtcaagagtcattgtaataaccaatagttttatatttacagtgttatatattcaactaattcaccaacaatttctatatagtgttgtggtgggccttccaagataattttagaacaattcttatttaaaggacatggaattaaagcagaaaattattttataaaaataggtgaaaaagaaaaacaacaacaaagacaacttttctttcttatcctttcagaatatttcagtagaatgggaagctacacttgaaatgcaagatggaatattttcccctaagctctccataatagaatgttggttataccatccttaactaaactaacactgtatcttttctgtagtactgataagaaaattgaaaatgaacaactcgttaatatactacctgaaaaatgtgagattagagagtccagcagaattttgaaggccaagtaagggggtgttcgatgatgagagataagcaactctttgaatagaaggattgtaagagatttaccctctgctattagcccccctctagttcccagggtttaaaatcaattacaatttcattggtacttaaaatttctcttattgtcacatagattgaatttcaaagagaacaggacagccttacacatagaactagtcagtggggagcagaaagtgtacaacctaaattgtttacttcatccacaagagactgtactatgactgggattccataatgtgatatctgaataaaagccttactttacttactgatttatttttcaaagttcagttcttaacaaattttgaaaacagaaattcaggcctggtcactatttattcttgagttaatttttcaagtagtttcaggatagccttagttaacttggcaaaatgccctgaaaagtgaattagcatgtttaaaacttggctaatcactccctcatccccaaccatagcaaagcctgcttaattttgagccggcgttttagcatacagtggtctaactccatcctgcacacatatcttgaattggctgatttggaagcaggcagacttccttctggatctcattcaatttagaaacaacagcagattagcgattaaatcggccaaacaacttctggctcataccaattaatttcttcaaggatttttcccttaaataaagtgtcttacacagttacagggaatgtctcaaacagcctgactatatataccactattgttgaatgttttcatttttaatgttaaaagctctgtcacagaaaacagcctggaaactctgtggggcaatgcaacccatcattctaccatactgatacaagtaaaacaacaatatcaatgttctaatacattaggaccctttataaagagttctcaccgtctaaaagcatcagcaatcataacggagctgtgggtatttctaagccaatcaacaaacagccataaatatacttggaatatacagagacattatcctacttcacttttaattcaacatgaagtcttttttaaatttaatttaattttattattattatactttaagttttagggtacatgtgcacaatgtacaggttagttacatatgtatacatgtgccatgctggtgtgctgcacccattaacttgtcatttagcattaggtatatctcctaatgctatccctcccccctccccccaccccacaacagtccccagagtgtgatgttccccttcctgtgtccatgtgttctcattgttcaattcccacctatgagtgagaacatggggtgtttggttttttgtccttgcgatagtttactgagaatgatgatttccaatttcatccatgtccctacaaaggacatgaactcaccattttttatggctacatagtattccatggtgtatatgtgccacatttttttaatccagtctatcattgttggacatttgggttggttccaagtctttgctattgtgaatagagccgcaataaacatacgtgtgcatgtgtctttatagcagcatgatttatagtcctttgggtatatacccagtaatgggatggctgggtcaaatggtatttctagttctaggtccctgaggaatcgccacactgacttccacagtggttgaactagtttacagtcccaccaacagtgtaaaagtgttcctatttgtccacatcctctccagcacctgttgtttactgactttttaatgattgccattctaactggtgtgagatggtatctcattgtggttttgatttgcatttctctgatgcattcttatacaccaataacagacaaacagagagccaaatcatgagtgaactcccattcacaattgcttcaaagagaaaaaaatacctaggaatccaacttacaagggacgtgaaggacctcttcaaggagaactacaaaccactgctcaatgaaataaaagaggatacaaagagatggaagaacattccatgctcatgggtaggaagaattagtatcatgaaaatggccatactgcccaaggtaatttatagattcaatgccatccccatcaagctaccaatgactttcttcacagaattggaaaaaactactttaaagttcatatggaaccaaaaaagagcccgcatcaccaagtcaatcctaagccaaaagaacaaagctggaggcatcatgctacctgacttcaaactatagtacaaggctacagtaaccaaaacagcatggtactggtaccaaaacagagatatagatcaatggaacagaacagaaccctcagaaataacgccacatatctacaactatctgatctttgacaaacctgagaaaaacaagcaatggggaaaggattccctatttaataaatggtgctgggaaaactggctagccatatgtagaaagctgaaactggatctcttccttacaccttatacaaaaattaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtaaacaggcgacctacaaaatgggagaaaattttcgcaacctacttatctgacaaagggctaatatccagaatctacaatgaactccaacaaatttacaagaaaaaaacaaacaaccccatcaaaaagtgggtgaaggacatgaacagacacttttcaacatgaagtttaaactatatgtagttgaggtgcttttccaaatggaaagaaaacaatctactacccaaatcaacacatagtttcctgtgaacaatatcagaaactaataggatgatcctctgtcttagtccatttgtgctgctataaaaaatggtacagactgggtaatttctaaacaacagaatgtttttgtctcagttctggaggctgtgaagtccaagatcaaagtgctggcaggtttggtattgggagtttggtttctgctttctagatagcgccttgttgctgcatcctccagagaaatgaatgctctgtcctcactttgtggaagggtcagaagggcaagaaagtgttcccttcaccctcaaaccctttcataagggtgctaatctcattcatgagtttggagccctcatgacttaattaccttccaaagaccacatctcttactactgatgctctggggattaagttttgacatcagttttacaggggatgtggtcattcaaaccacagcaccctcttttagaaacaagattgagagacaactttctggtattcacttatttttggttcatagagttcaatcattaaggaaaaatggcaagttgaaaagttgtgtagtaaaaaataaagaaaacttcaggccaatatccttgatgaacactgatgctaaattcttcaacaaaatactggcaaaccaaattcagaagtgcatcaagaagttaattcaccatgaccaagtaggctttatccctggggtgcaaggttgtttcaacatatgtaaatcaataaatgtgattcatcacataaacagaactaaagataaaaaccacatgattatctcaatagatgcagaaaaggtctttgataaaattctacttccctttatgtttaaaactctcaataaactaggtattgaaggaacacagctcaaaataataagatccatatatgacaaacccacagccaatatcatactgaaagggcaaaagctgacagcattccccttgaaaaccagcacaagtcaaggatgccccctctcaccactcctattcaacatggtactggaatacccggccagagcaattaggcaagagaaagaaatactgggcacccagatgggaagagaggaagtgaaactatcactgtttgcagatgacatgattctatatctagaaaacctcatagtcttgccccaaaagttccttcagctgataaacctcttctgcaaagttttggaatacaaaattaatgcacaaaaatcacaagcattcctacacaccaacaacagccaagccaagagccatatcaggaaggcaatcccattcacaattgtcacaaaaagaataaaatacctaggaatagctaaccatggacgtgaaagatcgctacaatgaggattataaaacactgctcaaataaatcagagatgacacaaacaaacgggaaaacattccatgctcgtggacaggaggaatcaatgttattaaaatgaccaagtgcccaaaacaacgtacagattctttttttttttttgtatttttagtagagatgcggtttcaccatgttagccaggatggtctcgatctgctgacctcgtgatccacctgcctaggcctcccaaagtgctgggattacaggtgtgagccactgcgcccagccacaatgtacagattcaatgctattcctattaaattatcaatgatattcttcacagaactagagaaaactatttcaaagttcatatggaactgaaaaagagcccaattagccaaggcaatcctaagcaaaaagaacaaagctggaagcatcaagttacctgactctaaactatactacaggggctacagtaaccaaaacagcatggtactggtacaaaaacagacacacagaccaataaaatggaatataagcccagaaataaggctgcacacctacaaccaactaatcatcaacaaagctgacaaaaacaagcaatggggaaaagactccctgttcgataaatgatgctgagataaatggctagccatatgcagaagattaaaattggaccccttccttaccatatacaaaaatcaacttaagatggattgaagacttaaatgtaaaactctataaaaacgctggatgacaacctagacaacaccattctagatacaggaatgggcaaagatttcatgacgaagcttccaaaagcaattgcaacaaaagcaagaactgacaaatgggaactaattaaacttaagagcttctgcacagaaaaagagaatgtcaacagagtaaacagaaaacctacagaatgggagaaaatatttgcaaactatgtatcgaacaaagatctaatatcctgaatcaataaggaacttaaacaaattacaagaaagaagtaacaaccccttaataagtgggcaaaatacatgaacaaacacttcacaaaagaagacacacatgtggccaacaagtatatgaaaacaaagctcaatatttctgatcattagataaatgcaaatcaaaaccacattgagaaaccatctcacatcagtcagaatgactactattaaaaagttaaaaaaaaaatagcagacactggccaagttgcagagaaaagagaacacttatacactgttggtgtgagtgtcaattagtttaaccattgtggaaagcaatgtggaaattcttcaaagggcttaaaaaagaactaccattcaacccagcaatcccattactgggtttatacccaaaagaatataaattattctacctaccataaagatacgtgtccacataaggtatgttcattacaacactatttacaatagcaaagtcattaaatcaacctaaatgcccatcaatggcagattagataaagaaaatatggtacatatacaccatggaatactatgtagccataacaaagaatgagatcatgtcctgtgcaggaacatggatggagctggaggccgttatctttagaaaactaaacactgcatgttctcactcataagtgggagctaaagaatgagaacacaggaacacaaagaagggaacagacacactgggacctactgagagtgaggggtgggagaaaacagataatcagaaaaaataactattgggtactaggactagtacctgtgtgacaaaataatctgtaaaaggggcccccatgacatgagtttacctatatgacaaacctgcacatgtactaaaataaaagttttaaaaacattaacatgaaaaaagtaacactgtacagtaaagcttaggtgtcatacaaatgggaaaaattaacttttcttttaagatttccttaagacaactaatggtttatctttaccttcccttcagcccttggcagctgaccgacacagctacctattccttccacacttccccttctcttaattcagaggtataaatgcttttatgtgccagaaattatattttatgttatgagttctccagacataagcaagaattgccaaacttgccagatggccctatacttatatttcaaagtttaaaaaagcagaatttaatgcagatacaggaatattatcaaagtaccatattatttgagcattttggaaaatatttttattttattttcaatagtttgtattaccactaatgttgttaatcacttcagagagtatattaatgctaaattcagaaataggaattttttttatagccaaagtttagatttataaaaaatatgagattctgctttagaagagattcttcatgaatagatttatatttcagttttcctggtgggaaatcttgttctttcaaagcctttcagaagatatcccattaaaagtgtacatttttcaaaagttttagtgtagtttaaaattattttggacataggaagagcacaatatatacttccatggaatagctacctcatattcatatactctctcgattttatttagtgtgctggcattagatttaaaaattaaagcacatatcactccttttcctgaaagttaccacttcttgacactgtacaattcttggacataattactttgagtctctagagtaagatcagtaagcaactaatgaaaaattcctggtagaggcagacagaatgagaaaatgactatataactgagatcaaattatatccacagggagtaggatgctttctatattctacaaaagtctacagcaaaaatgcactaacgtggatgaattgtgtgaagagtcattttgaattggtgaaaagactgaattacagattattgggaaagaaatgcatttttttcaggtacatccaatgggaagaattgctaacaaacattcatttaaaacagcatattcattgttgattttcatgtgagttttgatagcgtacttgaaagctgttaattatcttaagtaggttaaacaatttcttgaaatgtgtttatattaataattcacttagtaaagtagggctttttgtctgatagcataaaggtatattatagcctagaaagagtaaagagcctgcattttaaagtagttatttctaaaattcacaagtttgtagctctttattaccaatcttgggaaaacttctagacctttctttcagaggtcaactactctcatttaatagtcataagtacattatttttaataaaataacatatcctgatggagtaatgttttctagtttggatgacagatttctatagtggatgataaacctaaagtttttattccagtcatatattcacagattctaattataaatctgaggaactctaagaacataaaatctttttttaagcgtgatattctccaaacaagttaagcttttcttagggaaatcagaatattatgaggctttctagctctgtgatccaagtaacaatcttctccacaatgtgtaacaggctatcatactcagctgtcaaatgccttccagaaagcaagatatgccttgctggcagcagctcttcactctattgagggatgtagaatggtttggaatttgggctttcatttcctgttgtctgggttcaaatctcagctgagccacttgttttatcatcagttaaagcacaggtatcaggaagacctacttcacagattgctctgagggttaaatgaggtaactgaagtaaagcccactgcaaggtattaatatttagtaagagttgggtgaaaattgttatccattgcctggaaacatattaaaagaggacagtatgttcatctggtatgagttattctcattgaattttcattctccctatccctattcacatacattgctttagacaaatcttgcttccagaggaacactgctacttttccttatttagatttttttaaccaatgagtttagatatattctagatgaccaaattgaactttaatattcagaaattttcagaattcacattttcaccctttgataaaaatgaatttaacgtgattaggcactacacctgactatgcttgctcatatagagaaggggcttcaattcccacttagtaattttttttttttttttgagacagagtctcactctgtcacccaggctgcagtgcattggcatgatcgcagctcactgcaacctccacctcacaggttcaagcaattctcctgcctcagtctcttgggtagctgggattacaggcacccaccaccatgcccagttaatttttgtatttttttgtagagatggggtttcaccatgctggccaggctagtctcgaactcctgacctcaagtgatccacccacctcagcctctcaaagtgttgggattacaggcatgagccactacacccagcagtgattctgttttgctcaagaagaataatcaaactgatgattcttcttggtgaaatattaatagttctacctactttgtgttacctataaacattttacagttttacatttacttctctatggaatggtctaatcattaccattttcttcagagtgttctaaaaagtcaatatttactgatgatatcagtaatccataatgtattcttttctttccaactccaaatgtttacaaattggcattctctttacattttgtcttagaaggagcatttctttccaaggcgaaatacttgagagaaaatgcccttagtaggaagatgtgcttccagatgcctatgataattgattagatttttttgatatattgggttaatttttattttattttattttattttattttattttatttgttatggagttttgctcttgttgcccagggtggagtgcaatggtgcgatctcagctcactgcaaaaatacttccacactttcctcttttaatagactctactagcaacctgtcacatttaatcactactgaactagccatgttgttttaatctgcattctatacatatttagcataataaatgaaaacttcaaaaatcctccctgttgatgactggtagtgtaactcttgctgtatgcacacttatgctctgccttggattgttgacattctatgctcatgacactggaatcactcagaaacatccttggagctctccatctccacctgcatcccttctactgcctcatctcacttcaccccaaccatggtatttataccttgtgacactcaataaataactaaggaatagataaatatttagatcattatcctgggaattcttctttggtgcaagagtatgaggctaggtatcctctagggaacttccagggagaaatatgcaggcatacatacagaaaatatattagcatcacaaaggcaggggaaataacccacatacagatctagaatactttcagatggccctcataagttttctcttggtcctctgcagaactgcatacattacaatgcttgagtaaggactgtatgaatggaaacttcacctgcagttgtgatgaggacactctaaggtccttggcaggtatatctagggttttccttgctattaagtgtaaatcagtcattgcctggtaccctggacagtaataagaattataagccaattgaaggttgcttaccacaggggaatctgaagcccattcgagtactcagttactgcctagatagctgattttatatgaaattgacacgactgaagagacacagaaggcaatgttcacatcaacagtttgctgggcatgcagccaggcaaccatacacatctacataggcaatgcagctgatgaagggaaggcccaaagctggggagaacaaggcaatttgcagggatctatgcagacctcaggatcaggtttctccccattccctgaaggtcttctcttcttcattattctctggctgtctctatcttaaatactttcttctttccatttcttttttttttttttgagatagagtcccgctctgtcacccaggctggagtgcagtggcgtgatcttggctcactgcaacctccgcctcctgggttcaagctattctcctgcctcagcctcctgagtagctgggattacaggctcaagccaccacacccagttaatttttgtatttttagtagagatggggtttcaccatgttggtcaggctggttcgagctcctgacctcatgatccacaaacctcggcctcccagagtgctgggattacaggcatgagccaccgtgcatggcctatcttaaatactttcaaagacataatcaacagactagaaaaactagtttaattaaggcattggtagggaaaatatatgcatgtaaataaatacatggagtcataacccaagttggatttgttgtagaaaagctaaaagtcaagtaatataacatacatgggcagaatagaaggaggaagagttggacctgtgatctttgccaataaacggaaggtccatggtaaggatcagcccacgatggcaatgtggcttgatgccaatgatgaaaggttgaggaaagaaggtggcatgcctgcaaaagcaataatttatcctaagttcactgaatacaggtgagtaagtattgtattatttctactacaactgactgccacaggtcactgggaaagaggtaaaacgttcaacaatcttgcccacagattagcaaaatcttaatctgctctctgccaactcagaatcaaatcccaagcattaaaaacaatgattctctctggacaggataacaagtagaggtggtagaatgtagtaggcaagtgcggaggttttgtgagcacacagaccaggaccagaatgctgcctctgctctttccagcatgggacctaggacaacttcctaatccctccaagccttccttttctcaacaggatagagaataataattcataccttacataaatcattgtaagattaaagtagataacacaaaaagccctcaaaatgttaaataacaaccattgaaggtttttaatttgtattgtcattatcatgattatcaattctacttttccttgggcaaataaccttgtactcataaactgattctaacagttgtgtctgttttataggatgaacacatacatcattgcatggaaaaagcagaacttagcctggctgtgcatttcatgggtgcagtttataggcatcacctgcaactagaatagcaatattaattgtaatgctaacatatggaaagataaagataaaggtgtaagataaagctcactaaaacaaagggatcttgatgtggaaatgttagtatttagacaaagtataaggacgcaaatgagcaaaaagaatttttgtgtttacgaccatgatacaaacagttaagaaatccaggtgaaagtgggttttccatcccacagaatttgaaccgccctcattgtcacaactgtaggcatcggtgatggtgttatctttcttcgtaggctctctggtctctagccagtggggagaaggagatttcgattttataaactccaggacacatacattaatgagtaaaaaatgcttcataagctgatcaacagtattttttgtcatccttcaagtaataaaatacttaaaactcatattaggttctgacgagcccaaaaatgctaagaggagggaaagacatgatttgatacaaagtatagatctgatttctgtgtatgggaattcatatgaatttgtttttattgcactgattttgataacctgccataaaacttttgttaatgctaagaagaaagacatagctaatgctataaattcacttagatatctctgccttccatattttggtatcaaattaaatttatcacttcattatcccttcctggcagttggaagttgtagactttaatggaaggtgccagggttgctaatagaatcttctcgtcacagatgaaggaaatgtaaaagcgaaactcacaaagatttgataggatttatgctaaatgacaacgacacccaaaagcacaaactaagaatgaagcctgtgccctatcgggagaaggaattaattatccaacagatttgtaactctttctctactataaataaaaatgtagcaattttcacaaatgatcatttagccagagccagccattgcctatagaatggaattaatgaggacatttacataaaccttacagtgttttcatccctcaagactcagttcatctgttgcctcccaactgctcctgatgccctaggttgagatggacacttgtttccttctaattccataactccgatagcataatagcagttatgttgaggagtggtaattgaatggttacgggcacaatgtttgtaataaacagaattgggtttgcgtccggcttccactaataaatatctaaacctctttaacctcagttttcacctttgtaaaatgagtatatatacacatatgtacgtatatatgtacacatgtatacatatatatgtgtatatatgtgtacatatatacacatatacgtacatatatgcgcacacatatatgtacatatatgcacacatatgtacatatatatgcacacatatatgtacacatatgtacatatatatgcacacatatatacacatatatgtgtatatatgcacacatatatgtacatatatacatatatgtgtgtatatacgtacatatatgtgtgtatatacgtacgtacatatatgtgtgtatatacgtacatatatatgtaaaatgagtatatatatacacacataatgtgtatatatatacacgcatatataaaatacacacacaaaaggtatatacaattatgtgaagtatttagagtttattactattttttttttaacaattgatcatcaatgataaagagtttatcttattaatcactcaatctcaattaactactgcagtgcctggcatggaatactcaatatatgttaaatgcatagatgtttatttaaatgattaaaatccaaacactaaagtttctgaggcagggatatgtaaaataaattctaattagtaccaaaaatcaaaatctgtcagaattatgtgagttcagaaaagatgtgcgatacttgtttccagtcacaattttctaggagaggcatcctagataataggaagtacaaaggcagaaatcctgaatgcaaaaatagcagaatgaaagtacagttttgactcttttccaatttgcaatactaatgccctacaaaatgcacaaagtgtacccagagtgaatggaaattcaacctcaagtgttttgttttcagttctataaatgttataattttattatccattaataataatgctattacaagacaaaatgtcaatgcatatattaaaacactagaaatgtatttgatttaaagtttccagacaaatttcccactgggtttgtttgtataagggtaggtaggacgttagggcaaaagagtccagccctgcatgtaatatcctatcggcaatcaatttaaggttctgttctggaagctttggcctcaggcaaggccagcttttgttaacggaggctgcaggcactggctgatcctacaaagcaaagcacatggaaggcctaccaaaagacctaatcaaattttccatctttaagaagcagcttctcctttgagttgtgacaccacatccactacctactccactcctcaaggagcagatgtgccccttctctgtttctaagtcctagccagcctccctgatgtgaaaggccggaagtcttccaactccacacccagctgctggcaagttggcagagtgaaatgcatttgtttatgcccctagccattcattttctttaagctggtttccagccaagatttttatctaggtaccagctattcttttccagtggttaacttcataaggtttttagttcccaaaggctacctgattaaaagtaatttgggcataaaaaatgtctttagtatttcttatatgatatatcttattttgtcatagaaatattaccaaatgcttatcctatagtttctttcagagtgagtttgcatttcttaaaaaaattaacaatgtatttataatatgtaggatttataatatacacacattttaagtatacagttacactttagacaaatatacacattcacaaaactaccaccccagttgagatataggataaaaatattactggagaaaatttctgtcttgatttcaaataatatggatttgttactcccattttaaactccacataaatgaaatcatttggtaactgctcttttgtgtctggtttcttttccttatatgtttgtgagattcaattacctcaaaaccttatggatatgtgctttcatttctcctggaaagatacctagaagtagaattgttgggtcttacaagaaattgctggagagttttccaaagtagttgtaccattttatatactcattagcaatgtatgaattttcaagctgctcaatatctttgccaacatttatgttttcagtattttgaacattagctattctagggggtgtgaagtaatatctcattgtagtgttctactgtactttctaatctcacctaagcatttttctctcttttacctaggttgtcagttcttgttcagtgctttcctttatgtaagagaatactattcccaatcaaaggacagactaccaaaattatggtgatgtgcaaggtcacctgtgtgatgacatataagttgattatgacaacagatgcatctgccaaaacatttccttgatctcctcctgtaagcttcctttgggtttctcaggaggggcagaatgattcactatcaacatagtatcacagatagacttatcagaatcttggtgaattcattcaacagaagtcttctccattttggtgccaaagcgataaaggaagaataagggcaagggagtgggtctagagaatgtctgtttctcaactataccttatttcccttattcaactgccacgttctataagccttagctcctacctaaaccacctaatgcatacctcttagtccaaaaaatcatccttgaagctcattagaatcaagtgcatctcttattaattgattcaaaagtgggaaaaaccatttcatataatttaggctacataaaatttttaaatacagtgcaaatcaattgaactgtcctttcgtgttgcatctttcaacagctgaatattctatatggcatttcacagaaataagatttgatttgagaacatctgcagcagtctggaacacattttcccctgtacttgacttttagctcattatagctctcagatgttctctcggcaatcctgtgacatattggagtgttactgaacaaacatcagtgaagcctatgtcttgagtagtgtcaatctcagttgaaaatgtttcagctttcttagcatcaacactagaagaatttaattaacccactgaaactttcaaagtggtagttaatgcatggaagaaatgagaaatcagaaaagtggggggagagtggataagtgcttaacctcccacaagctgatgcctgccatcatcagcctctgcttaggcaggccatgagaagccttgctgctctgtgtagcctcctgcattctgccatgaaatctctggcttgctctattgcccctatggagatggagaaggtgtggaggtggcaactactgctgtcatgctcccctggtccccacacaaggtcagcttccaggctctaatcagctctcatccagatgctctcatgtttttagtaggtggggctgggagaccaaggtcagaaaagagctgtcgggagtgacacggttttttgcccactgctgctattacattaaggaagcagctggtgagataatgtatgccaaagtgctttctaaattataaagtgcttatataattgtcagggataatcactactgttgttttattctgaggttgcagaaaaagcactgaactgggatgttgggtatcaaagtccaccagaaagctgaatataggaatgtgtagggtccacagggaggtctttggtgagagtacagatttggaagataacaataaagagaggaatattggcttcaggggtcaaatgaccatacaacaatatgagagccagagatggaacaagggaataccagtattcaagggacaaaaaaatgtgtgtgtgtgtgtgtgtgtgtgtgtgtagggggggtgtcctaaaagattaactctaagaagtttctcttcacacacagaaatattgtttatctccaggcctttgccacgctttatgccttatcctagagtatttttcccactcctactagactttgtttcaggttatctaggaaaacattctgaaactcatcccctgttgtctgtgtatatctctataattgcaattatcacactatattattaataactgtttaagcgttctatttccacacagtctgtgatccttttaagggcacaattatattactgttaatgtttgcatctataatgaccagcaaatactaggtacgaacggttgtttccttgaaagaaataatagagaaatatgagaaaaatgtgtttaaaagtcaaagaatacatttcaagtatgaaggagtagtcagttgttgaatgtcacacagattttgcaaaataaagactgggaagtatctactggattgagtgatcagtagtaaataactcaactttagtgagagcatgtttagtgattttggaggttgccagtgggtagaaatctaaccttgagtagctgaagacagaaaagcaagtaagaaacgaagggcagtgagtacggatgacattttctagaacctgaactgtgaagggataaagaaattcagaccattctttctttctttttttttttttttgacattcctataagatatatatatcctaactttttggatcaggaaataggggctaagagaaagtatgtatattgtccaaggcttactgcttacaagacagaaaccatgagtaaggtgcacactcttcttggttccacagttggaggaggccaattgctggatatcctcctaacttatttaaagtcaggctgtcttagtctgttcaggctgctataataaaataccataaacttggtggcttataaacaacatacatttatttctcaccattctggacgctgggaagttcaagattgagacgctgggagatttggtatctgggggcggcctgcttccatacagatggcaacttctcactgtatcttcacatggtggaaggggcaagggatctctctggggtcccttttataaggacgctaattttattgccttccaaaggccccacctcctaatagcatcaccttggcagttaagattttaacatatgaattttgaagggacacaaacattcagaccatagcataggcacaatggggaaataaacatcttagctgtatgttatggaaagaaaggctatgtggtagcctggagcactctgacaggagaggtcagactactagtggagtgatataatgggaaactgcactacagcactagctacttgcagatgggaaggagtgcagaaaaggaagtgaagaacacaaaaaatgagtgtattagtccattctcagactgctataaagacataacagagactgggtaatttacaaaagaggtttagttgactcacaattctgcactgctgaggagggctcaggaaacttacaatcgtggcaaaaggcgagagggaagcaaaggcataccttacatggtggcaggcaagagatgagtgaagagggaagagccccttatgaaactatcagatctcgtgagaactcactcattctcatgaggacagcacagaggaaactgcccccatgatccagtcacctctcaccaggttccacccttgacacatagggattttggggattacaattcaagatgagatttgggtgggggcacaaaatctaaccatataaatgaacttttccatttcataatttttcacagggctaaagagccagctacccctttggaaacagttacaagttatctggaattctatattaatcctcataggctggttgtactgtggtaataatagacccttaaatcttagtggcttaacaaaataaaagttcctttcttactcagaaaaagtctgctgtgtctctagctgtgctaatacgtggtatctgaccatctaggccatccattttatgttgccactatctcagcatgagacttcagtgttcatcgtggcagagaaagggagtagggagaattgagtgctagtgcttaaacgcttccagccaaaagagtcatacaccacactttgctcacatttcattgactaaagtaagtcgctcactcatatggaacatccaaggggcagggaggtttgcctcttataaaaccagaggggacaaagaatagaaaatattagcgagcactagcaatatctaccacaaatgccaaaagcacgcaaagtcagatggcattccagccttactctgtatctcaataaagattatatacagtagcacaggaataattttattttcctaggaggactggattaccacaaatgctatgtgtttgcttttgtttgtttcacttgggacctacattaagtggaaataaagacttggtaacatttagggtttgaaaggtgcccagattgatagcctgatgatgggtgggtgacattcttcagctcagctgggctgggctgagcaaatgaagagactaacagccagcacaggacctagaaaaggctctatagtttgagatgaaatggtataaaattgataagtagggaagacaaacgaaatgctttaaagatgtatggcaacaaatcttcaaaaggcatggtcttgacagtgaaacaatccacagcagactggccagcatggtgtaaggggctgggagtgaaggcttcagggcacttccagtctataaggcacttcataaacagtgcctgaagctgcaaatcaaaggcttctcagtgcagcattagtcacattttctgtgcgcattgtagtcacatcttctcagacacatttcgaggggtcacctgtgactatgaagcacagaactattatagggcatggatttgagctaccaataacattgctttttaagattatacagcataaaatagagtggatatttgataattaggtggttaactagatcaatatgggtaaccaaacagagtaaccaggtttctaagaagaaaaggaaaggagatggatatttcatctgaatgtctaaactgatttggttaagtgtgagactgccaattattcagggcaactgaagatatcctcacctatccttcctaagctcccagggttttggtaacgctgttcaatatccatatcatcttgaagctaaaaataaatttaattatggtttgttttgtttgacttttttttttggtaaattaaatcccccttttattattccaaacagcagacatttcaattttttcccctgaaatcttagatgaggacaaattggcataaagctcaatataattataatttctgttgactctttacattatcaaaatgactcctttgtctcctataattaccagaaaattgtatcttcaaactaatattccctttattcaagtgagcagatgggcttaacgggagatataacaaatacatgtttttctcaggaagagtatcaggggcatagctcaaaattgcagagaggtattttctttactccataaaatgaggattgggaacaaagctaactggtttgctataaatgtccactgattgtgtagagatcatagaaggaaaggtagggcatgaattcaaggctagaatttgaattcaagttttaacttacatggatatagtaatgatttcattttaaatcctcaatctccacccagaacaagaacaatcctcattttttttcatggtttaaaagcaacatcagaattaatctggacaacttgtgttgaatatgaaaagcattattatacaagttttaagtatataattaaataaggtgcattctgattagttatatttgatgaagtatgaggaattatacttaaccactcccatgaatgtgacaaaagaagtaactgcatttgtgtttggcaatttgatgtagtaaggagaaatggggaatcataatctgtataagcacgatggacaagagaaaggaacttatgggagaatgacaacacaatgaaaatgtagtatagtttacattttatttcaggcatgcaatggtggattgtgataaggcagttgtagcagctacagattcaaaaagcacattgctgcccaaattcctagaattggtgacctgttggtactccacactcagacatggaagtggaaatccatgttctgtactatctcatcctatatctcaatgtccatgcaggcactgacaattgatcacacacctctgctgggctaggctttgaatcacgagcttcctctatacagggctcccagcaggtactaccaaatgattagagttgccttgtaaaatgaaccaacttacctctgggatgagagaaaccaagttggggaggcttacaggacttcacaaactactctggttacaagcaatgcaaaactacctcttcccataacttgagggactcttatcagcccctcccctaatggttcacgttaaattcagatgttaacttttggcaacagcagtagacacctcccttctgcctattttaggaagaatgatggactactcatgacaatttactgcccaaacttgaagttaattaatttatctccattttacctggaaagtgaacacttctcaattatttagaagctttttgggataggaggtgcttcaaaagacaaagatgctagcttttgaccagatcaaacaaaactaagctagtaaaatcatggtgtcaataggttaaggtaacttctaaaaacaatttgtaagtaccatctgaaaaatctgcacaaagcagagaaggaatcaactcataaagtattgctcaaatgtttctatctaccccaatattacccatatattttggaaatggatatatcacatattcagtattatcccaaattgcctatctatctatgcctctccatgttacgaatagttataataacaaccaccatgtattgattgcttacaactacatgctatacactttagatagaggatttctcttttttatcacagaagacttctgtgtacatatatgatttctaatctttacaaagtactgcaaaatagctatcatcatctcagtttgcctttacataaatggaggattgtgggatccatgtagctgttccaagctcacccagtagtaaggcatcatgcctggatttaaactcagaccttctgggtttcaagcactctctcttctgtggtaagcttttgactacagcacattgacttatttgtgggatcatcacacactgatgagatgatcagaagctcagaacaagatggggctaacaaattttatccaacattttttgcttctaaggaggaataatcacaatttataaaacaggtgtctgtcttatttttacaggatacttgacactccagcattctacttaagatatcactcaaaccatctgacgatattcagatgtagattaagtcttcataacatttatgcagtacattctgatctgataattttgaacctttgaactttcagggactggtgttttgttttttattttccttcctcatgccctatgaaatgaactaaaacaataaaaaatatttagcctcatgtgatctgactacaatcatagaaagtgacctcaataatatattttatatcaatcattacccaagtgactgatagaaatgcaaatatcatctggaacttttctaacaacataatgtaactgtctggcagtcccagggagaataactgtggggacaaagctgtaatgggagaagataacatggacaagaagtacagggccatacaatgaacttgaagaaaaatggctttcattcccttcccttctcctcttttctgggttagctccaagaatggtcattacagtataaaaaagtcccccaaaaatgttatcatagatggacaggagtaagctgcaagagcctaccagcaggtccttattatagattttccattttaagattctatatactcatcaataaaattaaattttctaattattacagtttacattttgaaaatattatatacatttattctgggcacaagttcttcatgagatacaagtataggaatattttctcccaatctgtgacttgagtttttattttcttaattgtatcttttgatgagtatgttaattgcgatgaagcataattcatctattttttcttgtatggttagtgtttttttggtatcctgtccaagacatttttcctttccccaaggttataaagatatttacttaatgtttgcttttaaaaatgtacagtttgaaggcaaggagtatatgccttctgttcaattttgctgtgaatctaaaactctaaaaagaaagtcttatagtcttaccttactgtttacttttttatatcacatatttaaaattacttttttgtcctgtgtgaggtagacatgaggtttattttttaatataggtatccaataattccagtactatttgttgaaagggctttcttttctccattggattgcttttgcacccctgtcaaaaatcaattgagtgtatatgtgtgggtctatttctggactttctatccattacattgatctatttgtctaccctgacacccaaacacacttgcttgattactgcagatttatagaaaatcttgaaggcagatagtacaaattctcccacttcccactttgttctcctttttcaagattgttttggctattctagtttgtctgaattccagtgtaaattttagcatagcttgccaacttctaaaaaacacatgttgggagtttgattgggattatgatgtatatacagatcaatccagggagaaataacatcttaatatatcttaccattattttaagtcttctttaatttttcttcagcagttcttcttaacttttattttagatgcaagggtacatatgcaggtttgtaataaaggtaaactcgtgtcatgggggttcattatacaggttattttgtcactcaggtattaagcatagtgcccagtagttatttttttcctgatcctctccctccttgcaccttccatcctcaagtaggccccagtgtttgttgttccctattttgtgtccttgtattctcattatttagctcccacttatgagtgacaaaatggagtgtttagttttctgttcctgcattagtttgctaaaaataatggcctccagctccatccatgtttccataaaagacacatctcgttcctttttatggttgcatagtattccatagtgtatatgtaccacattttctttatccaatctgtcactgatggccatttaggttgatttaatgtctttgctattgtgaatagtgctgcaataaacatatgtgttcatgtgtcttcatggtagaatgatttatgttcctttgggtatatatttggcaatgggattgctgggtagaatagcagttcttttttttgctctttgaggaatcaacacactgctttccacaatggttgaactaatttgcacttccattgacagtgtacaagcattctgttttctctgcaacctcaccagcatctattattttttgagtttttattaataaccattctgattggtgagagatggtattttagtgtgcttttatttgcatttctctaatgatcagtgacactgagctttttttcatacgcttgttggctgcatgtatccacgtcgctgtgaaagcaattctttcagtgcagatactacatatattttaatttgttcctaagtattttatagtttttacatgccattgtaaatgacattttaaaattttaatttccagttcattgttccaattgttcatgtagaaacagaactattattgtacattgtttttgtattatgaaactttgttaaattcacttattattttaatagtgtatttataggttctttaggattttctatgcacacaatcttaccatctgcaaataaagacagtgcaagcccatttttttccaatgtaaatatcatttatttatttttatgaccttattgcgctggttaggacttccagtacaatattgaatagaagtagaaagaatggacattcttgcccagctcttgatcttaagagaaaataatttatcctttcaacattaagtatgatactaggtataggatttttgtagacgtttccttctattaatgaattgctgaaggccattattatgattggatgttggattttgtcaaatgcttttgctgatctaaggacttataactagaatgattaagaactccaagaaatcaattaaaaaattaaaaaatggacaaaatatttgaatagacagttcacagagtaagatacatggaaggccaataagaacataaagaagagttaacatcttcttattagggagaagaaaattaaaatcacaatgagatatcaacacatatgtactagaatagctgaaactaaaaagactgagaatatcaaaaggtggctggaacatagaagaaccaaacacccacccacagctggtaggactgtgaaagagtaaagccactttggaactctgtttggaagtttcttgtaaaacttatgcatccaccttatgactgagaaattatacttctatgtactagccaagagaaatgaaaacatgttcacaaaaggagttatgcaagtatgtttatagcaaaaatatttataacaccaaaaaagtgaaaacagcctaaatacaacttagagtaaataaattgtggtattttaataaaatatagtattatttaccaacaaaaatgaactaatacctacaataatatgaaaaaatctctgtaatattatagtgagtgaaagttgcaacacatacaaaaatacatattctgtagaattccatttatgtgaatgctaaaaaacatgaacaaactaatctatggtggcaggtgctagatggtgtttgcttctggtggtggtaaaggaagatgtaatggctggaaaagtgcacaaggcagcttctaaggtgttggcaatgttgcatgctttggcagaggtgaggatttcacggatatatgtgtttgtcacaacttgtcaaatggttcatttaagacctctgtatttttcctccaagtaatttatatttcaataagggaaaataagtggcatagaagatacaaaacttttaaagttgtaaataggaaattatagtatcctcttttgaaactgtcattatgcttttggtaagggtcttgctgttgacatttacacatttctttggacactgctttattctctgtgttgaataactttccagaaaggaaaaaaatagataattagacatctacatataatattaccacaaccaaatagcaatagttttatgaaattgtgttatttcagttttttttattagtataaaattaaggggtacaagtgcagttttgttacatggatatattgcatagtggtgaagtttgagcttttagtgtaaccatcacacgagtaatgtacattgtacccgttaagcaattcctcatcccatatcctgcttctacccaattcctcatcctacaccctgcttctaccctcccaccgttttgagactccaatgactattattccacactctatgtgcatgtgtacacattaattaacttccactcacaagtgggaacatgcagtatttgactttctttttctgagttgtttcacttaaaataatggcctccagagggcacagtggctcatgcttgtaagcccagaactctgggaggctgaggtgggtggatcacttgaggtgaggagttcgagaacagcctggacaacatggaggaacgctgtctctactaaaaatacaaaaattagctgggcgtggtggcagacgcctgtaatcccagctactggggaggctcagccatgagaatcgcttgaatctgagaggcagggttgcagtgagccgagaacgtgccactgcactccagcctgggtgacagagcaagactgtgtctcaaataaataaataaaaataaattaaaaaaataaaaaagaaaatggcttccagatccatcgatgttgctataaaatacatgatttcattctttttttatggctgaatagtattctacattttctttattatctgtcaaagtacatttagctttattccatatctttgctatcgtgaatagtgctgccataaacatatgaatgtatttttttgatgtaatgatgtcttttcctttggatataaacccaatagtaggattgctgaggtgaatggtagttttattttcagttctctgagaaatctctatactcttttccacagggtttgaactatttacattcccaccaaaaatgtataagcattcccttttttttcccacatcctcacctacatctgttattttttgactttttagtaagagccattctgactggtataagataatatctcattgtggttttaatttacatttctctgatgattagtgatgttgaacagttttttatatgcttgatggggtttgtcttcttttgaaaaatgtctgttcacgtcctttgcgtactttttaataggggttacttgtttgttgttgttgttgagttgtttgagttctttgtaaattctgggtgacagtccctgttggatacgtagtttgaatatattttctcctattctgtaggccttctgttatctcgattatttcatttgctgtgcagaagctttttattttaagtcccatttgtctatttttggttttgttgcatttgtttttgaggtctttgtcataattatttttgcctagactcatgtccagaagagttttccttagatttttttctagtacttttatagtttcagatcttacatttaagtctttgatgggttttgaggggatttttaaatatggttagaggtagaagtataattcaatttttatgcatatggcaatccaatcatcccagcactatttattgaaaaaggtgtccttgtcctagtgtatactttttgtcaactttgtcaaaggtcagttgactgtagatatgtggctttctttctgggttctttattctgttccattgatccatgtgtctatttttgtaccagtaccatgctgtttttattaccacagcctaattgtataatttgaggtcaggtaatgtgatgactccagctttgaactttttgtcaaatttgctttggctatttggactcttttttggttgcatatgaattttagaattgttttatcaataactgagaatgatgtatctggtcatatggatacaattttggtttctattatcaaaacaaatccttgttttcagagttgctgtacaaccaccatgacagaatttctgattttatcctaatgagagccttttaatgagcacagattatgttcatttattaatatcaccaatatgtatttcatcatttttgaaacctactgaaagtacagtaatttggcaggtttattgttttcttctaaaatgactgctgctgttcttaaaaggatctagctggaattttaattatacattgactttcttttttcctcctaaataaggacacaacagataattcgtgcaatttaattctataaacatgtagcattgtgctaggtgcttgcaaactccagtatgaataagatattatctttccttcaaaatgcttgtaatgacctgcagcactggacaagaagatatacaattaaagaaaatgcagtacttgcaatactagttgtaggaaccatgggctgtaataaaataaaaaggagtgatttgactttcttggaggccaaggaagagggtcatagacagactcacaaaagaagtgacatttaagatagattctaaaaatatattaatgattgatcagtatgttcaattcagctaccatgccattactcctacatggtagacattgcattaggcactggcacacagtctgtgttctaggccgtcaagaagcttataatctaggcatattttgccaagtcaagaaggcataaaggttgctcacctgtctatctcactccttctattctggctttttccatgttatttttaccaaactcaattcacacataaaaaggaactttaagttcaaaggttatttctttacatattcttttcttttctgatgtaatggaaaaagtaatggcttggtaagtcaagtgattactaattcttaatgttaccaataagcttttttctttcaacattcatttagtcatcagttcacttcttcagtcaacatttattaaggcattaccatgttcagtgcatgtctagagaacttagatacaaagatgggtaagaaaagtgaggttattttctagtaaaggaagcagacttacaaaaatacaactgcgatgtgatactggttacagccaaggttcaaaaaggaaggagacattaattctatagcaaaggtcagggaatagctcaaaaagtgatgcttgagaactggaaggccattccagatgtcgggaacagcatgtggaaatgcatgcagatcccaagtgatcattagtttttggcctctactgtttttctttcatgactggtatttaggagtcctgttctcatcccaagcaccaaaaagtgaagacattttctttcatgcttttccagttgcaaaatttgttgttcaaatatcggactgtccaatttctttcatgtttcttaacgaagaatgtcaacataactcttatttcccataattaaaagtgccaaatagtaatgttttcttttctgaaatcactaaaatatatacattgcctccaactctatagatgaatttctggatgaagttatatttgcaattatattttcattttggtaatcttcacaagcccatagttaaaacctttggagccagatgtatggatttagaaatatcttttggattttagaaatgtaaaatggtacatacacctaattttaataaacactccctctccagccccagcaaggtgtggggtagcaacctggaatcaaacacgttaatctgatgttctctgagaggaataaagattatagcaagtctcacatcagttcaggccaggttttctgctgaatgaattatgtaaaaccatttggtttcagtatgttttggatttcagaattgttaatgagggattatggaactgtattgtaattattttcattgtacagttttataaaaaggtttacagagattaagtaacttgcccaagttgtctagctaacaaggaagcttcacataaatccagcagtcttactatttgctaataactgctgtcctacatgcagtttcttcattgggtatttccaacctctggccatttggaacctaatgtgatgcttctctggcattcctctcctgcctcttttatttcacttctttttcagctcaaaattatttattgtttactttctccatcaagagaagcttgtgttctgctcattgctgacttctcaatctctcactgttctattgctattctcttttttgtcccttttggcaatgcagatttttggatccctccatgagaattatgatgttaaaatgcagattctcaacacacctcttacccactgactcaggatcaatgctagtggggcctgggaacctacatttctcacaagcatgctgcatggtttttaagcaccaagagtttgacatcaacagctctgtgttgtgccaaagctgatgactgttcttctcaggaatttgctcttcttgcaggcacagattttaatggcttgcacagtaagtgtactaacacccaactacctgcccttcaacagccacctgaagaaatgctggttaggcagtttgatcagttaataagtaaggtaagcataaggaaagtatattaatatgctaattacttgaaagataacatgacatacttggccaaatccttgtttccatagcccaagtctcattttctctccattgtcaaacactgcactgtaatgggtttcttctaaatatctattctggtttattctagcctgacctatgagtgaatatcagagtagccattgtactttccaaacaaaattttcctgtgtaaagaagccagatacttctagagtgtctttctacaaagggtctacattttctctcatcttcctatagtatgcggacactgtgaggaccagcatactattctttggctaatgataggacaatgtgagttatatgcaaagacacacacacacatacacacacatacacacgtacatacaaacacacacacacacaaaagcagcagcaacattaagaaagaatgattagtttgctgagaatgatgcacatgtaccctagaacttaaagtataataaaaaatataaacataataaaaagaaaaataaaaaaattataggaccaaaaaaaagaacgattaggaaatcacctgtaccctagatccagagtactttgattcactactggggatataaatctaaagggataatcacctattgttttagtcatgtcagcctgcacaggagaatccagaagcacaaatctattaccagaccatctgcttattcctcaagttagtgttgagaaatgaatcactaatataatcacatagaaaaatcttcctttttttaaacgaatgataatgctgaaaattacacttacgattttgatgaaagctgagcttaacaaaataaagtctgaatcttgattcaaactattaccaaatcagtttccatttatgtcattgacacaagttgtcttcatcattacccatcttttatttgaatatgtaagttttgaaacgagtgtgaaaatcctttaaagacaaaacatgacagtgcaatgcagctacttccatttccgctcacatggcaaccacccaaatttgagacaatgattttatagatggtcataaactatcatgtcagagacaatttccttgagatatttacatcgaatgattgtaaagtcatttgtgaattttttttagttataagcaaccttaggatattgatagtcattgataaaggcaagaacactcactgtctaaatactgcagagtcagtttatgataatatgattagttacactaataatgctgcttaggcattatcttgctaattacaatattataaatattaatgtcacagtctttctgtttgattgccactcatggagtcattcatcatgacattttcctggaacccacattgtaagattttatttctttcctccttttcttttttcattactggacttgcaaccatacacattactcttgaagaagggttttttttggctatctattaggagagggacagtgatattttctactaaaactagccaaatataagtcaattatatgatgtttctcttattctttctgagtccctaacccagtcatccaaggcagagtacccagggcttttgttttccattctttttcatgtgacctgcttcaagttaagattcatttgaattattaaatgcttccttaaagaatctttttatactgcctctcttttttttaaagttaattattgatgtagtgacaagctgaaaagactaagaattataattttttcctcccctcattgagggctcaagaaatgtcttctgacaatggttatctatttagaataatacaaaggaaatacaaaggcaaaatgctgaatgttgttttagcagtgttgctaaaatcactgtattatagaaaacgtaaatgtagtgtatatttcttggaaaatagcagttagtgagaaagctgggaccataaccgtttgagaccgggtttaaccacacagcagaagcagttacaaaagatactgattagattttaattttaaaaacttccttatattattcaagactacagtgatttgattgtcttgaaaatagaaaggtaatgttataatttccagaaagcataaagaaatctccagactcccactgggaagaatgccagtcatcaccacagtaagcaagaatttggaggcactttacactgcaaacatcggtcttttccttttatataatcttgtgttgtattggtttataaaaaggtaactcacagacccatcatatggctgtaatcaagtctccttcagaaagagtccactgaagaaatcacatccaggaggcactgtgtttcctttgttagtgagaatgtgagatggtaaataagatctgaaatagaaaccaaggctgagttctcaagaataacacaggagatttaagcacataccttgtccatgagttcagctatacgtggaactggtttccctttctggtgactcacagtagctggactctgtccatcccagtcttgtagttcttcaatgcttttcagataaagcagggctttgaggccagtgcagtagtcttcgatcacagtgaaatcctgattctgaatggcactgcatacctagaaaagacagagcagtcaaccaagtgtcaaaccaagagataattctccaaacaaattcacttttctttgagtcaacaaatatttattttatgtgccaggcactgtttgaggcatgatggatcagtagccgtctggagatgggggtggtggggaggaatggactgcaaagaacacaaggaaatttccagggacaatgaacatttttcataaacttgcaatggtaatggtgtcacaggtatatacatgttccaaaacttattaagttgtatagtttaaatagctacagtttattatatgtcaggcttaaggagtcgaatttggcacaacataataaaggacatttaaattctcattgtcactctattgggatgtgctgcctgcaggcagttctcacgtctgaaagtggtcaaactgaggttggagtgctgtttattacgttaactcaaccatcacttacccctgcctctgtctccctcctcatctgctattgttctccttgttgtcaactatgatccagttacccaggtctttcctttcttcctcaaaaaaaatgccatagtctttctttgccttaggatcttttcacaagaccttctcactggctagaaggcctttcttttccacacatggctaactaccaaccattcctcaggctcatggtaaatgtcccttcttcaaggaggcttccaggagcccagaataggttatggccttcttttaatcagacatttttaacttctaattattgcattattatttagttgacaactcacttcccaattagaccaaagtttcagaagggaagaactgcatttattttggtcactatattatctgcagtgactaggacactgtttgtctgttagtctgctctccacaaatataagatgaatgaataatgatgatatggtttggctgtgtccccacacaaatctcatcttgaattgtagttcccataatccccacgtgcagtaggagggacctggtgggggtaactgaatcatggggatggttatctccatgctgttctcgtgatgatgagtgagctctcacacaatctgatggttttataaggggcttttccccttttcctttgcacttctccttcctaccaccatgtgatgaaggatatgcctgcttccccttctgccatgattgtaagtttcccgaggcctcccccagaaatgttgaactgtgagtcaatcaaacctctttcctttataaattacccagtctcaggtatatctttttatttatttatttatttatttatttttggagtctcaccctgtcaccaggctggagtgcagcagcgcgatctcggctcactgtgacctccacctcccgggttcaagcaattctcctgcctctgcctctcgagtagctgggactacagggacacaccaccatgtccagctaatttttgtatttttagtaggaacggggtttcaccatgctggctaggatggcctcaatctcttgactttgtgatccacccgcctcagcctcccaaagtgctgggattacaggcgtgacccactgtgcccggcctcaggtatatctttattagcagcatgagaatggactattacaaaagattaaaaagaaaagagaactaaaataaaaaattctggagttaaggaagtttgaatcagagaaattaaagttcttccactaaaaaaaccctggggattctgtgagtgtggctgggatttgagttaaagcttgaagaatgtggatttagatactgcttctaggttgcttatttccaaagatatccctccaattttgatatcacatgtagactccagagagtcatttacaacttcctgtagaacctcttcaccaacatggcccaacattacatcaaattcaaaatttacaacatgaattcaacatacttcccaatttatatttcaacttcaaacaatgaaacaaccattaaaacaaaactgagcaaagaaaaactcatttctatcctgttttcccagatgttgaatacctagtatatcagggtgtctggcaatggcagccaacaaagaaaaatcatgtcatgcatgaatgaaaaagaaaatgaaggaaatgcctgaaaacagaataataagattctatttcaaagactcttaaagccttttgggtctttgattaaatacattttattgtaagcctcgtgcctagcatgctacctgatacctcattgttgctaggttggttgagagaatttattgaaaacatactaggaggttccagaatggggaatgggataaggagagagagagagagagagagagagagagagagagagagacagaactctcatatatatatatatatatatatatatgtgtgtgtgtgtatatatatgtatgtgtatatgtatgtgtatatatatatatatatatatatatatatatatatatatatatatatatatatatgcctaggagttctcagcaagcagtggtagtgattccatgatgtgtacctaaaaaaatgccaggtgtgaaattctgggaatgctagcacttaaaaggaaggctaaggaagatgatcgtgagggacaccgagcagaagagatccaagagagttaagtcaggcgctgcagaaaggtcaggaatatcagagctggaagcgatgactggatgtaacactcggcaatataccggataacatttgcctttataggagagatctgcaatggagtagatgccggtttttttggtaggttgaggaatggatgagggatgatgaactaaagatatgcagccaggtcacatttctaagaagtttggctcctgtaagaggaagaggcgagctggggttataggttatagggttttgcattttgctttttacttttatttttgagacagagtcttgctctgtcacccaggctggagtgcagtggcacaatcatagctcagtgtagcctcaacctcctgagctcaagcaatcctctcacctcagcttcccaagtagctaggactacaggcacacaccaccatgcttgggtaattgtttttggtatttatttatttatttttttatttattcttatagagatgaggttttgccatattgctcaaactcctgagctcaagcaatccgcccacctggcctcccacaaatgctgggattacaggcatggaccaccatgcttggcctgcattttatttttttaaagaatgaaaataattatgttttaaggagatacagttattttacatttcagaataggacagactgatttctgtgtatgagatttctgtcaaaattggctgaatgattatgcgatgagaataaaacaatgcaatatctaacatgatgcgggctcttcttaggggccaggcactttgttagcacttttaaatatattatcttctttagtcctcaagataaccctaaaagataggtttaattttcagccccattttacaggtgaggaaagtgagtcttaggaaagttaaatgacttgctccaggccccatggttagaaagtggtggcaccagaattcctggccatacaatagaatatgacctagatatagacattaacagaggaaaaacttttaatataactacaaatactttcctacaactattgcatggaccaaatgcatacgtttttaaaaatttaatcaagttatcttcaactgaaatatagctctggttttgaaaaaatccacacttttagacaaaaattgtcaatgttttcaatttaccttcttacttgtacagtatgagtaagaatagtaacaagccaaaaccaaaaagcagaaacaaaaaccccttcattttctattctgaagtgctgcatgttagtacaatgtagaaaagagtatagaataactactaaatatgaacaagaacattttctaggaagcccatttacatcagattaaaaaaatctgtttctcaggaggaacaatttgaacattaattaggcctgttataaccttcttagagttggtggtgtttttttctcacaacaattataaggaacatcattatcatttcctccacaggggtattttttttcttttgactataaaagtcaactgatgctttacttaatcctctttgctcactctgagattctatttttttgtagtatatgcttatgggtatactttactatagtcttaaaatagttcaccatgtgaacataagaaatcagattttgaaaatcacataatgtcatgtactttatgggattttcatgattattgtaaaatcctgctgctaaaatgaatctagaaatacactgcaagggatgaacagtaaagtataatctaaatcatccctgatgtttccaggaagaagatacaaaagctatgagttatctcaatcctcaaacatggcacaatttgtatacagtagactcagacaaggagtggagtgatcagaatgtagacttgggatcttttaactgtagaagaacatggtaggtcccaaggctaagaaaacttcctctttcccacccacttctagactctttatcatacagggttggtgtttcacataattgggagctatactgagaatgtgaactgaacacaaaaccttaagaggaaggagagactacaagatacttactgagcaagactgggatagtgtgcaatgctggaagccctggaatccaccatgagacacgagtgctggaggggaccacttcagatatacttaatcatatggcaaatgtcacaccacttacgtacctttacaaaatgagtagtttaatttttacttccaataagattaaacctactaattttcctgatagaatttttgatagtaggaactttgcacattgatattttcttttaaaattttgttgcacatacaaatcaggtggggatctttttaaaatgcagattctggttttgtagctttagagtgggatcctggagtgagatcctgcattggccaaattttcgggggatgctgctgctgctgctggaccacacttagaacagcaaagtcttaagcactggcaggggtgaatctcatctcaactgaaatgctgactgcaaaaaaaaatttcttctaaacaaataggtttcttcttaatttttactattagattatatcaacattttcctagcctttcaaagaatgcactacttataataagaagtcatgtttgaagaaacaagaataatttgctgattaaatactaataagactaaaaataaaacttaggatgcaagtgcaccattgagaacagctttgcccatggatttgatctcaggaaatggaattgcttagaaagatgccttgtccttgcctaacttatatactccattgagggccttatcgctatctcaaaggtaaatcgttcttgttaaaactccaaacatgtagctgctatgcctaaatgggtgcattttatatgacatctcttaattgtttgtttaacagctctgattaggactcttaatagctgttaacatgtttgcttagtataatttgtaagttctttatggtgaaggctggtttatctttcttcacagcagggcatcaggtgccattataaggatcgttgccaccattaattatttctatatgtgtgaatatccctatagtgagctattttaaagagaggcccctagattctcagcaggaccagccctacacaggagcagagtaggtggtggcccccgtgcagcgtgatttgacgtgttccataaagcaccaaatagcctcctccaggggtctgacacagtgccctgaatttttactttaggtgcagacgcatttaatagaggccgacctgtgcagaacaactgtacaaatacctggatggtaacagagggttgtggggagctattcttttctcattatttctcataaaatgagattaactagattatcagtaaattacctatttatggagatttacgtcttcaaaatcttctttacatacattatttctttcagtactcaaagctgacttagtcaggagagggagtaatattcttacttgtaaaatggaaagagcttggacttgaagtcctgtttcttaaagtcaatcttgtggtttctatgccatattaagttaagaggctgagagcatgcacacagaagtcaagcagaatagagttccaattacatcttagctgtgtaatcatgagcatttttttcacttaaaaatggagattaaatacttagcacataggaaactaaaaggcaacatacttaagtgcttaaaatagtagcttatactcagctacattggcaccaaaattaaatttcatactatgaataaatcattagggcatgaattaggcaggatataatttttttaatgtaatacatttttggtcaaatactgcagaggaaaggcatggaccttatttttatttgcattaaataatgatctccaaaaaaaaaaagctttggttttgttgtcagaagactcaggtctgagacccaactcttgtcatctggcagctgtgtaactagggctagtcatttagcttgttgattcccttctccctcctttacatctgaaaaaggaggatgataacatcttattgttgtgaagattaaattataccatgaaggtggaagtactgtggaaattataaagcttagacagaatggtactaaacctcataggtattgtagaatttcacgtaatctagaatttcaagtgcctggcagaggccaaaatgggaagttttgcctattaaaaaaaagctcacttcatctgaaaagtaaaataaatttacaaggaagctatcaaataaaatctaaattagattaaaaatatttatcccaggtaaataatttggcagagaagagttctacaaaagcaggaacaccctgagactggcacatgcttttgtgtaatcaaatagcacatttttcaaatgctattttaaaatataacaaagtttaaaaatagagatcttgatctattaaacacaactcagataaacccatgaccataattatcccttttcatttcttatcatacaggtggataaactacacttcaggacttagaagtatgtgcctccaggttatatgcaagtaaaatatatgcttacaatttaagtctaaagttgtctcaaatttactgtaaattcattagtaaaagttctattggagaattactacatttaagcaaaaacggaaattcttctgcaatggttatcacatcacaaattgcattaataactgagttatgtatctggaagaggttcaagaagcctcccatgaatgtggttcatatatgaaacactgaataagaagggttgttcatccaattcttaaagctttctcaggaaaaagaaggttatattatctcttcttactaacctattttgataagcacatattttgtttaaactatgcaaaacatctgcaatattttatatagcactttatagttttcaaagcatgctgtcaaaaagaaatatctatacaatgatttatagttttcaaagcatggtgacaaacaagattaaagggaatttagactttttttcagaccagcttcctcatttcagagatcaggagtccagactggctaaatgatctgtgcatggtacacagctagttggaggcagtgctggcagacccgcctggtttgaagctctttctgctacaacactgtctgtcaatatcatcgtacagcagttctaagagaaagacagagaaggtgctatgaattgttcagtaagtgaggaaattgaaaccaaacattgaatgcagtgcccaaaatcaagattagtaactgggagggccaacagtaagactcagaatttctgacctctgcagagctttttatcttttctttttattattatttccataaatttcaaagccttaaatgagatgaaagtcttacatatataaacaagcatatatgtataattttcataaaaagaagcgaagtgatttcacatttattagttaattattatgacagaaatccacagatttttaacatttaaggttttaatatttggatgacccacttaaaatttcttactttaactggaaactaaatttctcctgttttcggatgttatgcagtttctaattctatctgtccacacctactgattaaaaaaatcagattttctgaaggcatggaatcaataattactcacggaattgagttctgaccagtactaacaaacagatgtataaaactacattgtactttaaaaatggatgtacaatacatatagataaggtaagaattcagaataacaatatccgcctatgagcttttggtactacataaacatggcattgcttactggaattcatgaataaaacaccaaaattataattttataaaaatataggttaaaagacagcccctggagatacatagtaaatagggaactagatggggatgtatttgtatattcacataaaaccacaaatcttagttgttctatcatattagtttctatctgttggagctgtacaacatcaaagtcatgatgtccctatatattgcatttagcagtaatgtaacggactacgtgaagaaatcaaagtgagagtttctaagtagtttcctggcaattgagacagcaggctctctcatctgctctgtaactgtggcagtgcattgatttaaactccttctgagatctcaaatgcttttatattcttaggtctctcaagcagctttttttttttttttcccaaagtgataaaattccagcattcagcagaataccatcttgtttcccccaaaaggagagggcttatttcagctttgctacgaaactgcacaggatcactaagtaaaatagctgtccaaatgtcattctactaagaaatctggctttgagttcagttgtctatgttctgaccacagcaaataggattgggaaaaaaagaacaacaaacgaatagccccggagatgttgtttttcaaaagttcagttcagaaaaattgccgaaatggataagtagttctgcttattaaatattttcaaagttgtttttaattgccactcattgatcagtccaaatggtataggagtcatttattttgtaaatcatatatttcttctcagtacattacttatcctctgaaacgataaattctctgataaattttaagtataaaaatttcccccttttcctccaattaggaaggaactttatgtagcctgaaagtctatttttcagtgtaactctgtggtcattctttaattaatttcttaacccaagatcagctaaagacagactgaagagaataatatgttttcaaggtatattatactgagatccaaaccacattttgccagccagaatataatcatcaattctccaagtattttctcaaaggcagcatatgatgggccacccactcgactactattcagaagagcatttgtgagactgatcttctctgttgcactttgttgatgacacagtttcactgaagatggcctgcgctgattagtcaaagggctgtgccctgcaggcgagactgccctgcccccttccttgtatctgtcctttacaaagtgagctctaactggactcagatctcaataatgactgcaaccaagaaataataataagaaccatacagagacacagcacctctgtctgccttttatgtgacactagagataaaatgggtgagacaggtacaacatgtagggccaaagaatggtgattactgttctgtctcttcaaagatattgctgttgatggctctgcttcccaacgggcataaatacaagactcaaaagactgaggtaacaactggagtcttctacacaccaggatcctatgcagcccattctttggttaggaactgtggctgcagtttgaggaagcttggccactgctcttcagaggcagtaggatttttctactaacatcgtttctcaccatcaggctttggtgctgcatcagttaccacagcaattttcaattactctgcagtaacacaggtggtggtgtaagggtttgcatgtagcattgtgcatgctcagcacctctcatgataaaagtggggtaagaaaaggaaactaaacatccaaacaatagctgtcagaagactcaaatccttaattttaggcaatctttctttttcaacagagtcaacacagctgggaaaacttgatttatcatatcattcactaaaataccagatagagtttgatcacagaggagaagtcataatgcctagagagaaaaagttcaggaaggggaatatcacactctggggactgttgtggggtggggggaggtgggcgggatagcattgggagatatacctaatgctagatgacgagttagtgggtgcagcgcaccagcatggcacatgtatacatatgtaactaacctgcacaagcacatgtaccctaaaacttaaagtataataaaaaaaataaaaaaaataataaaggatgagttcagaccccccccccccaaaaaaaaaaaaagagaaaaagtctatagggaaaattaacgcatggaatttttttctgaactctgaagatggatgaaagttatgtggtcactcaataactaagcagacattcacattccaaaaaaaaaaaaaaaaaaaaaaaaagaacaactcacctacaatgagaaacatttgttaacatgaaaataacatctcaaatagtcctgactacctctgaaagcattcacaattcagtagttggtgtgatagttaatctataattgataaaaacacaaatttgtgagagagtacaacttggctgttatcagtgagtcaacaattttgactgagttgccaatatattctgggacacaaaagttaaagttcagttgattaagagtgaataaactatgtaagagttaagcgttataggaaaaacaaaacaaccttaccaatgttgaagttaatatatggtaaacacggtgcatatttatgggagggctagagaagcaaagcaataaggtttgcatttgttaaaaggaacttttaaaaatactaaactcatttttaatccctttactgtgtatatggaaaaataaaagctcacaaagtttgtggttttgcagaaagaccaggaaaataaattgtatgctagttttttttggctttttgttttaatgaaggccaagaacctaaaagtaaaatgcctggtcttcagctacaaaagatggatctactggaacatggttacagacaaacaaatgcaatgtccaaagaagtagttttatttatgccttctcactaaaagggcacatattttatgatttgtgactctgacaacctgaagaaagattacaaacaccagtaaaagttctaggctgagggttttaggaggatgcttagagatgaccatataatttaccatccaaactgtgacacttgagagtaaacaggaaactattagtgaaaataccaggaccagcagtataaactgggattgtcctgtaccactaggatctgtgattcccttactcagagggtttttttcattcctgtctttatattggagggagactttcacttgtccctgtggaatgcattccaaaatgctccgtcacttttggtttagtttaacattctggtctttcagatacttatgcaggcctcagagcattaacattggatctaattcaccaggcttttattacttaggtggggatttggaatcctggagacctgacttgatccaataagaggacccgacttgatcctgttattgacccagataatcctagatttaaagggtcccttttggcctccaactttaaaaaaaataattaatagactttgctttttagtacacttttagatttacagaataattgggcagatagtacatagagtttcatacgcccacaccacccccaaactcggcaccttccccattattaatatcttgcattagatggtacatctgttacagttaaagcaccaatattgatatgctattattaaaattcatagtttatattaagattcactctttgcattgtacctttctatggtttttgacaaatgtataatgacatgtattcatcattagagttttatacagaatagcttcactgccctaaaaatctactatgctgtacgtattcatccccctcaccctcacctcccccatcccctggcaaccactgatcttttttactgtctccatagttttgccttttccaatatgtcgtataattgaaatcacatatatgtagctttttcagattgacttatttcacttagcagtatgcatttaaggttgctccaggttgttctgtagcaacagaatccattcacctattgaaaaattatcacagtttttttcaactttagtaagaacttcatatattttaaaatataaaaccatttttctatatagccaaataatattttaacagttaataaaataaataattccttagtgtaatctgatatccatagtacaatttccataatatttttatagctagtttatccaagcctaggttcaatccaggactgcatgttgcatccagttgctctgtccttcaaggttccttttatctggcacagcctctttttcattgcaccagcctgttgtagaaaccctactgctggagtctggctgctttgccacagtgttctttacatttctttcctctaacccttgcatctcctggaaacttgtacttgtcttgaatcttgttgaactctcacacaatgtggttcactagaattgggtcctcacagggcatctccagcgcttaatgggaatggggtggcagggaatgaatggtggacattgcctgtaatcatgggcttgctctgctgtcccactggacttcagtttaacccttttatgataaaagatacaactcagaaacagccaaacagaaaagatgcatagggcaaggtatgagggaggggtacggagcttccatgtcttctccagacactcctccaagggtctttcagcctaaaaaaaaaactcaaaggggacaggggaggcaaggagctactcaaaatccatatcctttaagggtggaaaagtttggtgtattttaacaaacttaatattctgtccttttgtaacttatttctttatgctttacccaaattcccttatgattacagcattttgaaatttacttaggttacttattatgttttaaaccctgttcaaaatatgtctacatgtagcaccacattgaaactcacaatagcaccttgggtaagtattattattttcttcagttagcagatgggtaaatatggggtcagaaattacaggccttgattaagatcacacagctactaaatggcagaacaaagattaaaattctggctcagtttgcccacaggatcctttcttgtaaccacagtgcagtcctgctttctgttctgaccactactacgaaggcaactggctttcatgtgaaaacagggagattttatatatatatatatatatatatatatatatatatatatatatatatataatctatatgcttataatgcatatgtgcgtatacatgtttatatgtttatgttaatgtatgttttatatgtatgtgtgtatatgtttttaggtttatgcatacacatacatatacacacaagcatctatatacacacaatattgtatgtatgatatacaatatatgtacatatatttatacatagacacatatatacacatatatacctatgtatatgtagtatagatttcttgtaagtattatatcaaataaaacatacataattatctacttcagtgcctaaataactgcacaataggtatcatcatttggatctcattcaccagatttcagagacacagcaaaaagggcagagactatatttcttttggttaccattgtacacccagtacttaccacataaagatctttgcctggcatatgacttattcaatggatgaatacatgaagcaaaataaaaatattgtaatagtatcagtcagtgacaaacacaattccctttcattccctgtccagaatacatttttctctccaattatacgaatatatcataattaagaactcacatcaatccacaagagaatacttttctctcaacttttgctgcactctatatcactcattgcatcatttatacattaatatctttgcattattacttaactcttctttggatatgccaatgtatttcaaggatgcagggagtaactctacttcttcagcatttttcttcatattcaaagtactatttgtcacagacaaactggacaaagcctgtgtatagatttttgcatctctggtgttcccagtctggatgcctgagtcttatcagcaattgtcatttgattatgttttctcttatgatagtcccctttaacactaactgaaggaatgtataattaagaaccctataaaagatctcatttaacaatgactgaattcacactatcaaatccaatatatacaatgttctaattttcacacatatatattaaagcaatctggattctaactctaataaaggacagataaaacagagcccagagacgctaaggaaaaggtcttctatcttgttttgtgtctagactctcttatctaatttttttgggtttctgcatcacgcaccaatagaggtcagtccagcattcttgggtcaggactaatgttttcattttaaagaattccctctctatctttaattatttcaagttcataaagttcaacacttcatcaaattactttgaaatagttcaaagtaaatgataaaatgtattattgagcaaatttgtacaaatattattgccattgtaaatgatttgcttcctctaatacaggtcctgcaaaaccactgcacatgcccagtaaaggccttctctctgtttgctgggaatgtagccaggagtgtttaatagattattctgaatttttaccagaagagagcaattgtttttgtttttttcctctctttcttttttcttttcttttctttctttcttttacttttttttcttcctctttcttctttctctttgtttcttttctttctctttcttctttctctttctttctttctttctttttctttcttctttctctctctctttcttttttttttttgacagggtctcactctgttgcctaggctgaatgcagtggcatgatcatagctcactgcagtctcaaactcctgggcacatgcaatcctcctccttcagcctcctgggtagctgggactacaggcgcatgccaccatgcttggctaatttcttaatttttttgtagagacagggtcttgctatgttgcccaggctgatcttgaactcctgggcttaagcgatcctcctgcctcagcctcccaaggattgggactataggtgtgacacactgcacttcgccaagggagctatattcaaactcatcatttcttcaaaaactttctctattactcaaaaactacctactaattaatttattctttcattcagcacatgttaatttatggactaatcttccggtttcttttcacattcaattatcaaacaaaattgttgactgaagcagcctgaggttatgctgtttgttttctgtcagaatgaactttccatgcagagctgttgtgaggaccaaatgagataagaattattaagtactgtttactaggaaggcctcccttgttggtataggtgtgacacaatgcgtttgattcagaggtaagaataattattcaagttctgaattttgtatctgaatgtgcaactggtgtcttctgaggtgtgtgtgtgtgtgttccatattgactaatttctaagatgagttgctccattgagctccaggaccaaaatgatcatatctttgttgtaaacaattaacttaatcacacacagataaacatataagatcgaattttgagacaaggaaatgacctgactttcaattgttatgctttgagagtataaaccagaatcatattaccaccgcctacccataaatcaatatactacaggttttaaatcaattattgaatatgaattaggtcaaagaaaaggtaaataaggtaaataaatacaggtaagttggattttatgtgttttatatttcatttttgtctataaaatgtcacactttaaaccattgcttatattttgaatctgcttataatcaacattacctaattaaataatgctcagacatgcaatagaattggctttttttaaactccctccagattactcacatttattttttgtgttttagagacatcaggccttataaatgtgcaacagtattcttactgtagctgtgtaagaccaggcatgtgtaatgtgtgatgtatttggccatacaaattcaccagtgattaaactgattttttgcttgtgtcattgtttttaggctcaatgatgagtcgtgaaactttcctctcacctcatattcattgctacatctggtgtcatccagagttaatatccacgatgtactgattgatttaggaagatgataatgagattattgcttatgcccttaaagcatgacaactgaaatcccatcattttccacatgaggaaatatgctaaatattataatatctgacaggtctatcactgtgggattaagccagctatctgaaacaaaggtttgatattttgatctttagacatattatcttctttcgtcttacaaacacagaattgttgatttggagataatggcagtttatatttgcatgcctacatctttaattccacaaactgttaaggtcctcctggttcatatctgccaaacgaagctaagagcaaacattgttctttcttctgattatgtggggcatgaccatagaataggggaagagaaatgtttaacttggagcatttatatttcaggccaggagaatctggtttaaaagttttcaaaagactgatgagccacaaaaatattaaatgtgtaggaaatctgaccagttaaacaaaatgaagaaggaatgtttcctgaatattcaaagaaggcaagttatagaattggatgagcatgtgtttaaagctaataaatgtagagcgtttttttccctcccccttggagggaaatgttttatagaccatttacttattttattttaaaatgtacatttgatatgaatttcatttcttttactctttcctcaaagattcataatcttctaaaatttagcttcaggaacatatttctgagaatgacaagagcttactgaaactggcctctgaactattcaaaacacagttgcttattgtccatttttaaacattcattggtcgagacttacagtaaggcattcctctctccccttagcatctgtccacaagcaagtatgcacatatctgctttgtgcctaatattatttcaattactatgaggcattcttaagaagtgaaaatgcacatacatcctagctaggagataagacatacattcatttatctgcattggcttgtacatgcattttcaggcttgagacatgtctagaaagtaggatagaaacaaaaagatactagtgcctatctgacattttcacggaggtgtttcctaggcatcttaactatagccagaataccattcctagtttttccactcactgcagcctactactccaccagtccaaagtctagaaatcatctctgtccctttcttttcatgtccacaaccattcaatctctcagcaaatcttgtagcactacttcaagtatatatcgtgaatctatttgttgccataaccacagcttcttgcaactggaatcaatcatggtctctcacttgcctcactgcaatactttctttattcactcttgaccctcctaaattaattatctacacgacagctaagatgattatttaaaaatattaattagatcataatttgccactgcataagaccaacaatgtcttgcctcactttgcaaaaatgggaacactttctacaaagtactgcatgatctggtcctgcctcgttggccttccttcagtatgtcaagcttatttctgccttaggagctttgctctgtctttctgcaatgcctttctccatactttcccatagctggatgaatcttctcattcagttctcagcttaaacatcactgctctagagacgactccccagccagacaaggtatcctcccagtcactatcacacagtctaatttaaattctaagttaatgtaaagtacttaccactatctgacatttttcttatatatctgtttcttactaatgtgcctggtacccatcagacactcagtaactatttgctgaatgaatagaaattatgaccactacataatacactgtttgataatatgaaccttatgactgagtttctcagcagatattagttattgacagcttcaaagccaatctctccttgatatatttaacttttcttaaataatatacagttttaaaatttaaataacttgcaacattcataaacatttatacaaagtatgattagtgcttatttgtaaggaaatactctaattttaatactttaatacatggaacacacttgagaaatatagaaatgcttcctacccaggatgccttaattaggcagacttatttaaacgtgcttatttttaaatttggcaaggttcacaaacattaattttgttacattgctgatactaataatagtatacatatcttaaataaaggtattatgtcattttcccgtaagactttgaagaaatagaactcctaagcatgagtgaaatcccccttacttgcctacagatttttctccactatgaatcgctcccaattcagatttcaaaattcagtatttaataacttcattacacatattatttaagctatctttaagtatgtgggtttttaaaaacattattatggtataatttacatagcataaaactcgcccactatacgtgtgcaaggcaatgatatttttgtaaatttatagagttgtgcagcatcaccacaacctggttttacgatattccaattacccaaaagttttcttgcatcctttagcagccactgttcaccacctccccaagcttcaagaaactactgattcgttgtcctcataattttgtcacatccaatcatttcataaaaatggaattttataataacaaatattagtattttgtgtctttttatcttcatttagcatgtttttatacatgtcaaaatattctgtgctattatggtgtcagtctattttattgctgaataatatctcattgtatggatgtaccaccacattttgtttaccattcatcaacctgctagggatttagactgtgtccagttttggggtattagaaacaatgctgctatgaccatctgtatgcaagtctttttttctggatatatatatttatttgtctgagatagatgatgtggagtggaatttccggattgtatggtacatttttgtaacattataagaaactgccaaactgttttccaaagcagttgcaccgttttatattccaacaagcaatgtgtgaggattccagtttctccacatcctcaccgtcattaagtattatctgtcttttgatactagccattttagtgggcagaaatgtcaacatagtgtaccggttaaaataacagattctgggccaaattgtgtaaattcatatcacaacttgccatcctgtaacttaacattcctgtctatagaatgaggacagtaataacacctgtcttagcctgtttgaacatgctataacaaaaatgccatagactgggtagcttcaataacaaacattcatttctcacagttttggaggctaggaagaccaagatcaaggtgtctggtgaagacttgcttccaggttaatagatggccatctttttgctgttttcaagtggcagaaagaataggggctctctggagtctcttgaataaaagcaccaatctcatttataagggcaccaccctctgacctatcaaacctttgacttaccaaaggcctatctcttaatactaccagattggggttagtattccaacatatacattttggggggacacaaacattcaatctataacaataactatctcacaggattactggaggtataaataaattattacaacttttagcttacaaaaggtgtgtctcatagtaaatttcacatacaagttaaccatgataatttttttattatcataatttgcaaagtgacaacatacttaacctggctgtggattatagttaggctttgggaagctgtttatgttctcttaatgatcgcttccttacatgatgtcagcttaagatagttaagatggttatcacaatgtccaggcactagaatgctaggtactgtgaaaatcaaatcacagattttaaatgacaattagaatggttaaaacttctaaatggtcagattgacctgccagactacttcagtcaaatacgggactttgaatgaatgattgaaccagtggtttattttactaataaaatgtacctgtccatggggataaaaaaggaaactgctgtaggtaagctgttttcctttacaaaattgtcaattgtttgaccataaggaccttcgtcctctgttttctttatcccatttatttgtttccttgtcttcttcctccttcacttgactacgtgggtgattaatggatcactgctgctttgaccaaggaataaatggagaaacggcaaaaggatgatattccccctctcgagttactaaaatgcccattttagacacttttctagaaaggcacatgtgccgtctgcttgtcaaatccctttctgattaatagctttagaagatgttttgcatgcatgcttgccagtttttaaagcacattactgaaagcatttcagagcacttctcctgggtttccagcaacaagcagggatcacttctccatgcttaggtcactgctgtactaatttctccaggttccagcaagccttgggggtaccaatagaattccctaacagcagccaaattttacttgagaccatccaacttagccttctgtattgcatcctgggagtgacttgatttaggttatgatatggtaaaactattataaaattgcacactattttcactcacctgtgtaccactcatagtcatatgaatataagattcaactatttatggattgtcaaggttttctccatttctgaaagtctctgtttctatgaaaatagcatggatagattctatctagttttaaaaagaagtaggccaatgaataaaagatatatgaaggcacatcctccaaaataaggcagaaattgtgtataactttatgaatattcaaccacgttggataatcacaagtgtagaagagagtaatatagtggattaagtgccatactgggccaaaccacagggtgttgaagaagctttcaccaggtgataaaatccagaaggactgggtagtggactctccagaaggatgaacttcaaccaatgcatgacagaaggcagaagggaatagaagatacatttcctctccattttttcctgtgatggattaccccaaggcattgctttctagctagtctatctggagttgttccacgtggccagttggctgtcttgtctcactgaagcttgtgaagcagtggctaactcagtaatgcattaccttgtattcaagtctcatctttctctgtctcatttccatcttcttttactcttgctaccctagaattttatctcccaacaaaacattaacacttgaccctttccttgggttctgctttctaccaccctgagctaagatacatactagtcaaaagctagaatagagggctgtacattttattttaaaatttggcataaatgcataaaactactagcagactggatgatgatgatggctgatgatgataattaatagcttgcatctgtggtacacatactttgcttcagatactgtatgaggtgctttgcatatggttgtgaatcctcacaaccatactacgaggtaggtagtattattatctccactttacagataacaaaattgaagtataaaatgttcacacgtctagtaagcccaaggtcatatagctaatgagcaacagagctgggatttcaacccaaacaatttgatgcattttcatttgggttgaagcattcatgaataaggtggagttctcagtgacttcctgttcttatttggtgattctgagactgatatcactacctgtccagtagcttctggaaaaggtcatctgagtccttgccatattatttatgattacaatagcgtctctagagagccgaagtccactttctttcaagaatgtatggttgttgaggcatctgattctctacctcccaggctattcaaattgtatgttcaaaaggaggcaatgaaaaacacacacttagttcaactaaaatctctcatacctttccttgtagtagaggtttatgaaaggtctacgttattttatatttaactgagggcacttgtagtttcatccttgaatcatttttacccaccatcacatagtgcataccacattcctcctgcgcacaaacaggcacgcccatgcttaggcccatgacactccatcacgtgactggcgctaaaatataaacgttcccattttgtgtggtataagatacttgtgactgaaagtgacctaagcattctttttgcctttctgttgctctatttaaaataatgactacagactctctttcaacaaagggtcatttgtgtcaatggacagaagagaggatcagatcacctgcggtaattgcaaattaatgttctcctggtaatgcactaactacacactattgatctacaattgaatactagaggctactgataagtgatttttactttcctgcttttttgtgtgtgcttttattgctttttccataatgcatttttctttcaactggaattttctctaattgtctccatttttaatttcccacagtgagatgacttctaacttgtaattagaatctgtaaaaattcatgtctctgtctcaaaagccttttagaaatctactgaactgtaactttgatgccataaaccacatatatgatgcacagatacatagtttgagagagccaagctttcgaattttttttttattaatactcagataaaacagaaatccatttggccctctatccaaaatagcaatttgttgagtagtctgcagtaaaacattcaaaagtttcccctaaaagcattttacttggagaacattgatgacgtgtttttctttccaagagcaaacttttaaaatatgagtaaacggtttattacaagataatttttatttttaagtgtgtgagagaagcggggcacagtggctcacacctgtaatcccagtactttgggaggccgaggcaggcaaatcacttgaggtcaggagttcgagaccagcctggccaacatggtgaaacccgtatctactaaaaatacaaaaattatagccagatgtggtggcgggcacctgtagtcccacctactcagaagactgaggcaggagaattgtttgaacctgggaggcagaggttgcagtgacttgagatcacgccactgcaccccagcctgggtgacagagcgacactcgtctcaaacaacaacaacaaaaaagtgtttgagaagaggatgcagatttccaattgagtaaatatttatacacatcttcacagcatacttttgacaatgttaaattttctcatgtttgtgtcaaaaccttaattgaggatctggcaccgtggctcatgcctgtaatcccagcactttgggaggccgaggtgagtggatcacctgaggtcaggagttcgagaccagcctgaccaagatggtgaaactccgtctctactaaaaacacaaaaattagctggacatggtggtgggtgcctgtaatcccaagtacttgggaggctgaggcaggagaatcgcttgaacacgggaggcggaggttgcagtgagccgagatcatgccactgcactccagcctcggcgacagagcaagactctgtctcaaaaaacaaacaaacaaaaacaaaaaacacgttaattgataataattattctatctggtggaaattaacacacgtttgtatttcagtgttgtacttgatcatgctccctgtttagacagaggtcattcatcctaaatctggtttctgaactgtggtctagaaatcacctgaaatggagagatagtctgacagtaatttccttcactactatttgtaaactttaagcttatcattgattttctgtatttctaaataagagacatagttgtgatttctaagtgttttcaggcctgtaagaactttgatattttactgtaatttcttttacaatcattatttgcagctagtcacaattaaataccatcaaaataaatgtgtgcccaaattgtttgcttattttttattcctaagtcatgattatctgtaccaaaaaaaaaaaaaagtaataactgtcaaccgcatggctagaattatataagtctggtactctttcttttatcagtttataactagagacagatacaattacagttgatattcattttacaagcagtcttagggctggaccagagtgctgatggctccctgatgtgccaatcattgttggataatgaaaagcggggcaacaccagggtggctggagcaggagggagatactcggaggactgagactctgaattgtgatactcgctttatcatattaaatatcatttctgtcttattacaatccaatgagataggtactataacttccattttatagataaataaaccaaggtttatagaggttaaataattagcccaaatttatccagctagtaaatgttgagcaaagtattataaaacttcaaagctccttctcttaactaccatagtatacatgacaacagaaccacatctgtatacataatgatagcacacaaatactgtaaagaatcttcaagcttaggatgaactgagatttttgaaaaatgttaaaactaacaacagggttacattacaatatacattaaaagtccagagttcactatgaatccatgtaacaaaactgcacttgtaatccttaaatttacacaaagaaaaaaatgaatgcattaagaatgaggaaactgaatgtactgatttatgaagaaaaaacaaaaaatgaccaaaaacatacttggtattaggtatatacaggtataaggtagagcaattcagctttaatttcatctcactaataagagctacccatccgcctttatacagaggttctcagagcttggttatatttttggtctagagctggagtcattcccgtctagctactgtctaacattgtcttcctcccttttcctcttttctgttctgcctcagcctttagacatcctagatcaaacccaaaaagtcaataaataaatcctcaaattttctaatcttggacgatggttaggaatgggaccttttcaaatctactccataagcaataaactcagaagaaatcagaagtacatcaacacaaggaaaaaaggaaaacaagaataaaataatgatatgccaaatcaaaagtgatgagtgggctttctgagaagaagataacatcagagggtctagtttgttgtgaacacattgaaaatatggtgaccaaacatgagactaattgtaaataggcctatataaacatgagtgtaggtgttaggaggataagagattttaaagtttggtttgttagtactgcaaagagaaattgccttttgaaaaggcaaaggtgcctaaaaaattaaaggtaccagtctgaaaaaagcccagaaaaatctaaatttgttttgaaccctttagaagaaagatagtaatcatcaggtagagagagaagtcctttaaaaaggagagtggccataacccatgagtttcattttataataagcttataattcagtgttatttagaaaatgtaatgaagaaaagttataaagaattgggacagtacacacaaagcaaaacagtggggtacaaaactgaatgtcatgaatggaaactcttagagaggtagatgcttttgagggaccaactgtgaaatgtatttttgtggtctgtattttcattttttgttgcaagataaatagagtggcaaaatctattctcatctgaacccttgggaaaatttttaaatatattaagcacatgatagaactgaatgattctggaaagagatgtgtgttagtctgatttttgcattaatatttaataatgttttcccttgtatagaaagttaatgatgatgtcctaccattaacagaacatgtgctttggagacacgtttcctctagaagtgatgaatttgagttgataaaggcacatttttggggcctgtcacccttgagagtagtaaaaattatttataagcagctaaccaagggtgaaggaggcaaaaagtagccctagaagagaggagaattaaaattatgaaggataaaaaccattatttaaaaatgaacaagatgccatggaagtacaaagtagaaaaggcctactgagcattcactccaggatctgaggaaagcgacagctggtgtggtgttggcctgtgaaaatgtaaagaccttgccactctttggagacacttcactcctcaagtgcagaataacatctaaaatcgttatcatgacctgaagtactccacaagattcatctctgcctatgtctttctcttcatttcctatcattctcacctctgttcagtatgtcttgccatgcctgaaataggccatatttgctcacttgtataactacgccttgatatttatactgttgctctttctctggccaggaggacactcttctctcggggtctctgaatggctcaattattttatcattgctatggtttgaatgtcccctccaaaactcatgttgaaactcaatctccaatgtggcagtattgagaggtggggtctgtaagaggtgattggatcatgacagctctgcccttatgaatggattattccattcacagattaatgcactatcatgggagtgggattcatggctttatacgaagagaaagaaagacctgaactagcgcattagcaagcacaggcccctcatcatgtgatgtcctgccccacctcaggactctccagagagtctctgccagcaagaaaactcacaccagatgcagcccctcaaccttggacctctcagcatccataactgtaagaaatacattccctttctttaaaaattgcccagctttgagtattctaagtaacagaaaatggactaagacatcactcttgtgagggagcttctagcatgcaagcttcctgagggcaggtctcaggtgtctgagaatatccttgtatccttgatgcttgagctctgcctgggatatagtggggctcattcagtgataaagatgccattttatgatagttcattgaggacattattttcattttcctagataccacatttcaaatgtaactaagataaactttttaaaagaagctatactgtttatcttactgtcaattatatccctctatggtttttccacaaaatcttctctttgccatggttgtctccacttcagatgtatacttaagtttttgtacccaagaatagaaccttacttttgtcactaattaactgtgtcttctcatattagatcaatcacacatgcatcttctgatttttctgagtctactttgtgatttactctttaccccaagtttactccaaatttcatgttatccaaaaatgtgatcaaatggatttctgtgcttcccccaagtagagcccaggagccccagagtagccagtcttctagaaatctcaaagttttctttactcagcacgtggaaagaatgttcagaattcaaaataattttggaaactgaagaagtcagggataaattacttaataaagacaaaaacaaatatctcacttataaaattatatgattgggtataaacaaactactcacagatagagctcaagaactaagaagaatcagcaattaataagtgaaagagcaagctttcacacgtttattattttgaattcctctttcattttgctagcacatttcttgagtacagtaacagggagggtgggggatgcagagacaaattatagaatagaaatcaggtaacatggttcctagtcctactggaaagtcaactgataaaatgaacccaaggaaattacaaactgtgaatatgcaaatctataaatggggttaaaaatgcttattgatatacccacagcttcataagaattatataaattaacatatggaaaaggctttttgaaaaaatagaagataatattcaatagatcattaatactctttataatatattttgctatggtctaagagctctctaaattcccagtacagtccaggttttctagatctctaacttagtaccaaagtctataaaacattgaaaaaattttaaaacaaatatcaaagtgtatacatcaaaatgaagtggtcttttcaaaataatcacctgggaagatgttcgcactactcagaacaattttggaacatttctctgtaaactggtaattaaaatcaatttatgaactaacagaaaaaagactcatgactttggatacctaattcactcaacaaccaactttgttcattcatcttggctctctttagctttttaaaatgggaatgaaatccattcccaatatataaagagtagttactacattacctccccaaataactatttctaatagtcatttggatgaacaagacacagttattaaaaaatcagttacccatccaatcacaactcatttcaagtgacactgataaaccagaaatagaggaaaggaacaaagatatacaatgtttagaaagtaatatgtgaaataagaatatctaaacaactgagattttctttcaaaatgaagaataaaaatagtagtttaagactttggtcaagcatatgaagactctttgaaaaagaagtcagaccgttaattagtcacatctctgcatacaattcaaataggaacggacagtagaaaggatttgtcagggacaagaaaaaatttaggcaaggacatttatataaggtgaggaattttctgtagctatacgcctgcaaacatcttagctaactcatgattattctctaacttgaaatagtcattgtgcaatgctattatttttttctatagtaaaactgtctttcaaaaatattagcttgagtttcaattaatttctcttgaatctagatgttaatctttctatcaagtggagaatgtgtagtcactcaaagacgtaataagtttccatttaatttattctctttgcttataaacaacatttgttgcactagaatcaagatgctttttaaatatgaaaacctcttgaaaataacctttcattaaagtaatttaaaataatgtgataactgacacagcaattagaacatcattgaatggataaactaaaagcatttttttcttatatattattgtgagaatattgagtttccatttttaaaaatatctacttacatattattcttaaagttgtaagtgaaacattcattaaagccaggacacaagaaattgcataatggaaagaaaaaatatttctcttttaaccagttatgtgaaatagttctgattccatttaaaataattttgaatgctgtcaagtatttttactacatttgttaccctctggcctgaaactgaatgatgatgaaataaaaaattagaagttattgaataaatattttccacctacccaatgaaaatttgtaatatagggtgcaaaatttttatcacctaaagacacccgtcagtaaagttgaagcaatgaagcctctgtgtatattatgaccaagagataatatgggtaatgcatccatctgcactcaagtggaaacagtgtcatcgtgctgcttcaattacttctttttctctaattttaataaaataatacatttcctgatcacattaaaaaattccatttagcttgaactagctccatcagagcagctttgattattgttaaaaattgatttggttatctgagttcagcgagtggccgtcatgtgaccatgactttccacagcaaatgcccactatgcttcatctttccgttatatttcaggattttctattaactttagtgacaaacccacgcagaaaagatagaattaaacacacacacacacacacacacacacacacaaacacacacacatccatacaatctcaatgaaggcacaggtcataattgtttgtgaattaactgataagttttgactttctgaatcaaagtccttaaggtaatgaattgtaatggcagtatcattaaattaaattaaattatagaaacctacagtcattcagtgaaaaaagtcatatagtatgtatattttttatctatagaggaaggtgaacattttataatgaaacctatcactgaaagcaactgactcagtctgagctttggttgtaatacaaatccctaaatagtttttcaacagaaattatagtctagtacttgaatactagaaagaagatacaggactcattgggaagataagatctgggactaacagtgaaatcaaaacttaaaaaagccaatgttaatttattaaagttctcccttcaaactgttttgaaggtgaattactagttatttatttatttttctcttcatgaagaaataattggcagtcagaagcaaacttctttttttcagagtagccctcaaaaagatttcaagacctcaagagtttatgaataatttgagaatataatttaacaggaaggtttttataaatatcagtacctgaaatttactgataattttcatctgtccttttcatatttctaatttgcatattctaactaatgaaatcctgtcaaataagattaaaaaatcagggatttcaaagacactgaagttcacttaaataaattagaagtcagttgggttgactgaagaacttataagagcatttacccaggaaggcaagcctgtaatcggttttgaatcttatttctaggccacggtgttacatctggttctgttgtaatagtcattttcactccaaagttgtactaggaaaatgatctggagtacccagattactctctagctaattccttagtttttatattcaggattcattgaagcattttatccattttaaaattatacagatttaagtgtactgcatgatgttttgttatacatatacacactcaaatgatcactacagtcaagccaattaacacatctctcattttacacagcaacattttttttctggtggtaagagtgtctaaaatctactctcttagcaaatatctagtataaaatacaatattattaactagattacttgtgctgtgctttagatctccagacttactcatctgacatgactgcaattttgtatccttgaactgcatctctttgtaaccttcctacttcatgcacccacatatgataactacagttctactctctaagtagtcaactttttttttttttagattccacatataagagagatcatacaacattttcctttctgtgtttggcttatttcatttggcatagtattctctaggttcatttattttgacacaaatggcaggatcttttttacagctgaacaaaactccattgcgtatatatgctgcaatttcttcatcattcatctattgatagacacttaaggttgcttccatatcttggctattgtgaataatactgcacagaatatgggagtacagatctatctaactatctgtctgtctgtctatctatctatctatctatctatctatctatctatctatctatctatctatctgtctatcatctatctatatgtagtgctgatttcatttcctttggggatttacccagaagaaggatcgctaggtcacatcgtagttctgtttttaattttttgaggaacctccatattgttttccataatggctgcaccaatttacattttccccaacaatgaacaaaagttgccctttctttacaccctcatcaacatttgctatttttatcttgtttgataatagttattctaacaggtgtaagataatatctcattgtagttttgatttgcattttcctgaagatcagtgatgttaagcatctattcaaatatctgtgccatttatgtctcctttggtccattatttactcaggttctttactcaaagatatttactcgggttctttattcaaagaatattaacgtctacactcaagacacataactctcattcatttttctatgatttcacattttttttcttcaaagatcctgagtaaaaaattttgaaatcaggttgttttttttttttttttgcttttgaattgtgagagctccttatatattttaaatattaaccccttaaaagacatatggtttgaaaatatttttccaaatccataggaagtcttttcatcttgttgattgcttccttttttgtatagaagttttcagtttgatgtagtcctacttgtttatttttcttttgttgcatgtcctttgatgtcctattcaaacaatcatagccaaggccaatgtctaggagcttttcccctgtgttttcttccaggagttttatgatttcaggtcttatgtttaagtctttaattcattttgagtttgagtttcagctgagcccagtattacgctgaagccaaacccagaaaagggtactataggaaaaaaagtataggccgtatctctgataaacatggttgcaaaaatcttcaccaaagtaataacaaactgaattcaacagcacattaaaagaatcattcaccatgatcaaatagcagtcatcttagagatgtgagaatgattaaacctatgcaaaccaataaatataacaacacattaagagaatgaatcacaaaaaccatacgataatcttaatagatgcagaaaaatcatccgacaaaattgaacatctttcttaataaaaactctcaaaaaattagatatacagggaatgtacttcagtacagtaaaggccatatatcacaagcatgcagctaacatcacagtcaatagtgaaaagttgaaagcttttcttctaatattaagaacaagacaaggatgcccactctcctcatttttactccacatagtactggaagccctagccagattaattaggaagaaaaagaaataaaagcacccaaatcagaaagaaaaagttaaatagactctgtagataccatattatatgtaggaaactcggaagcctccaccaaaaaacagaacagttagaataaatgtattcaataaagctgcaggatacaaaattcacatgcaaaaattagtgatgtttctataaattaacaaaaaattatccaaaaaagaaatcaaagagttaatctcacttacagtagcataaaaataaacacttagcgataaatttaaccaaggaggtgaaagacctgtatactgaaaattataaaacatgaattaaagaaattgaagaaagcacaagtaagtgataagataccctatgttcaaggactggaagaatcaatagtgttaaaatatccatactatccaaagcaatctaaatattcaatagaatccctacaaacattccactggcatttttcataaaaaaaatcactgaagagttttttaaggtaagatgattggatgatttaccattgaaatgttgacatcttgtcaaagcatgttacagaataagatcatagaaataaacagtgccacggagaaatgatacattccaagaaaattcgctcaaaaattttgaagcaaattttgctatgaaaagcaataattgggctgggcatggtggctcactcctttaatcccagtcttttgggaggctgagtgggtggatcacaaggtcagaagatcgagaccatcctggccaacatgttgaaaccccgtctttacaaaaaatacaaaaattagctggatgtggtggcacgcacttgtaatcccagctctactcgggaggctgaggcaggaaaatggcttgaatctgggaggtggagattgcagtgagccgagatcgtgccacggccactgcgctccagcctggcaacagagtgagactctatctcaaaaaaaaaaaaaaaaaaaaaaaaaagaaagaaagaaaaaagaaagaaagaaaagcaataattgcccaataaaatgtaatctgaaaccctaagagacatttcagtttatcaactgtgaggtggaccctatttagctgatgtgattactatgcattgcatgcttatattaaaatagctcacataacctataaatatgtacacctactatgtacccacaaaaattttaagaagtttaaaaaaagtatatgccctttactgatcaattacattatactaaaatatattataaaataattagagataaatgcaatttggttttctcagcactgcttaaactagtagtgaagaagaacccatataatggattttataaataaatttcagtgcatttataatatgggataatatgtgaccactgaaggtagcactatataccgaagtatgttgagatgcaaaatgtattttggtatatcaagtgataataaggttcagtttgattatacatatgaaaataaataaataaaaataaactgtgaggtgatatacaatattttgtgaacttacatttaattcctcaattagcaaaaatttaagcaaatgatgctgtaacctaggttttttcttcaataaaaattttctaggatttacaaccatcattttttaataaaaatattatctttacaatgaagtctgtttttttcccacagcacttatcttatgttaaatataatacacttacatttaacatttattgtatatttttctgtctctgctcacaagaatgtaagcccaataaggtaacagactttagttgtttttttttttaattcacagaaatactctaaatttctacaacaatgctaagaatatatagtagggtctcaatacatatttattaaaaaatgaatgaatgaattattctctgtgatgcatataaagcaataaagaaggtatgcgctatcacacttatgcaacttatgaaaaaaattagctttccattcttgaaatgtcattactcttcttaatgtcagtcatatggcttaatttacaaacatagattcatttggaacagattttgaaattactaatttgagtgtaaatctttattttagcagtgaactcacttaattacataagattttgaaattactaatttgagtgtaaatcttaattttagtagggcactcacttatctacatagtctatacacatgatgaatagtgtatgagaaaaatcagaatcaaaatatttatttatattactatttctacacccattacaggacttctatttctatactctagtgtatcagcaccataacctagatatttaaatcaatttcatttgtctggttatacctgctataaagaattcattttgttggtacacatttcacttgtgaatagaaatcattagaaaggtggatttaataaatattgtaaaaccagagaacagaattcggttgggcaatgagaggcaatgaaaggatgatatgagagaaatgggaggatgatgatcaagaggctaagggctttgagctgtatgaaaaagattcgaactaactgcaagaaagaatttgaggctgggtgcggtggctcatgcctgtctgtaatcccagcactttgggaggccgaggtgggcggatcacgaggtcaggagattgagaccatcctggctaacatagtgaaaccctgtctctactaaaaatacacacacaaaaaaattagccgggcatggtggcgggcacctgtggtcccagctacttgggaggctgaggcaggagaatggtgtgaacccgggaggcggagcttgctgtgagctgagattgcgtcactgcactccagcctgggcaacagtgcgagactccttctcaaaaaaaaaaaaaaaagaaaaaaaaaaaagaatttgatgggaagtaaaaaaaaaaaaagacgaataaaaagaaatactgactagtacccaagccccagcagacattaaacactatgtatttggagtaagcccaattgcagagttacattaatttctctaataatattcaacagcttaaaactatactgaacgaaaggttaggttaacccaagattagggagtggaatgaagtgaaattcagttagaatggaagaaagatggaaatatatattctctaccctccactgaactaccaaactaaaattataaattcaaatatttcccaccttatgaccatcctaagtatatatatatatatatatatatatatatatatatatatatatactgattttaattcatactttagctaatattggttaaaaaaacatgttctggctgagttaaaaatctgactcaagctaatggcagagctgaaaaataatctttaaatttctacagattagattgccagctctctgggcaataaattctcctaggtattttttagctgaaattgtcttgatttcctcttcatttctgaagtaaaaacctatgtgtgaaactttacatttttaacaaaatcatttgggaaccaatattttaatagccagaaagtctctgggctattcccagctagagctaaagagataatgatttcttttataccatgtgaatccttgtatcccctcttcacaattctggtaaaaacaaaacaaaacaaaaaacccataaccaagcacattcatttaacaaactcattcaaccaaaatttactatatttctgttacacaccaagcagtcaatacatggggtaaccaatagcttatgatggggcctggcataaaaagataaatttaggcaaacagatttcctctcttagcagtctgagctgtacacaaaggaatataaatcatcccattataaagacacatgcatatgtatgttcactgcagcactattcacaatagcaaagacatggaatcaacctaaattcccatcaatgatagactggataaagaaaatgtggtacatgtacaccatggaatactattcagccataaaaaggaatgagatcatgtcatttgcagggacctggagggagctggaggccattatccttagcaaggtaatacaggaacggacaaccaaatactgcatgttctcacttagaagtggaaactaaattatgagaacacatgaacacatagaggggaatgacacacactggggcctatgagagggtgaaggatgggaggagggagaggatcaagaaaaataatgagtactaggcttaatacttgggtgataaaataatctctataacaaaccacatgaaaaaagtttacctatgtagcaaacctgcacacgtaccctgaacttaaaataaaagtttaaaaaaagaaatccaagccaatagacagtaagctattgggacatttcatggagaaatgagagctaaaaggctgcaatgtggcgtgggtctaagggtcatgacagccatgtgatagaagttcagaggaggcaagagtaagccatggagagaacaagagtggacagaaatttagtttcttctgaagaagaaatcacatggctcacaaaagagagatggcaaaggtcttgccccaggactgtcccactggttcttgcagttccagttccagggtcctttcatgtccagaatacaataggcttcatgtgcatagtcagtgagtttctgattttccatctaagaggagcctaagtagaaactgacatttgaataattatttcaccattcatttctatgaggacacatagtactctatgtatatttacatactaggatctgcaccctgagcacacatctacacccaggacacataactctcgtttagttttctatgatttcacttttcttctcttcatagaaacttgactctaagaggtaagctatagcctgaacatgtaagctttgagtgggcatggaagacttgcgtattactaatattcccgtcttacaggtcctgtgatggaagacaggcaatatgcccagttggaagagtatttgctttgtggctgtgaaactctagatgggaattctggctccattgctagtcatgtgactgctattaaagacacacctaagactgggtaatttataaaggaaagaggtctaattgactcacagttccacatggctggggaagcctcacaatcatgtggaaggcaaatggtgagcaaagtctcgtcttacatggcggcaggcaagagagcatgtgcaggggaactcccctttataaaaccaccagatctagtgagacttactcactgtcaggaaagcacaggaaagacctgcccccatgatttaactacctcccaccaggtccctcccacaacatatggggattattacaattcaaggtgagatttgaattgtaatctcacacagagccaagccatatcaatcacttttatcctccaagccttagttgatgtcaataaaaaaaaatatttaaaaatttcactctcaagtaggttgtggaaatactatatgtagcagcaattactaccagcacatggtagacagtcaataatctttacttccatgtgtgacttgcccatggtcacatctgacaatgagcaagagtctcttctgaaacccactcataactccattgtatccttcagctcaggtatttctacatgtggatgaaaataaattcaggtgatactcaagcctggatactgttatcttccagattctttttgaagacactgctccatattcttcctttcttcttgatatcctaaggtgccttcttttatcattttctttcttctgaaaaagctttctttagccattcttttggttaaggattcctggcaatacattctcttagtttttcttcagccgagaatgtcttgatttctggctcatttctgaaggatacaggattttgagctgacagttcttgttttagcatttgaaaaatgtcccactttcttccagactccatggcttgtgatgagaaatcccctgttattagaattgtttgtccccaataagtaaggtgtcatcttcctcttgctgttatcgaggttttatctttttcttcagttttcagaaatttgaatatgatggattttggtatggatttctttgaagctgccctctttggaagtctaccttgacctcttgaatctacaggtttatgtcttttgcaaaaattggaatatttttagccattattttttttccattcctgcctttttcacctctcctctgggactctgaggacattagtgttacatcttttgttatagtcccacagttccctgagggctgttttcattcttttcttcagtctttttttctctctgtttttcatattggccaatttctattgccaatttctattgctctatcttctagttcactgattttttcttctgttctcttattttactattgagcacatcagctgagttttatatttaagtgattgcatttttaagtccaaaattttcatctttatatcttctatttctttgatgagactttctgttgtttcatttgtttcaatcatacttgtagttgcttgttaatgcaattttataatggaggcttaaaatatctgacagataattatagtatctctgtcatgttaatgtgggcatctatcaattcttttttatgatccagcctgaggttttcctgggtcttggtatcatgagtaatttttaattgaaatcttgacaattttggtataatattaagagactcttgattttatttaaactttgtttctgctagctttccttggtgtcagtctggcaggggaagtggagaatgccacctccttaatgccagatagaagcccaggtatcttacttggctttcttggacacccgaggggcatggctcctggttactgctgggaggaggtgagaattctggctctccagtaagcctgcactgacacatccctggctaagagatgcaggcacgccttgttgctgctccctacttggccttcactgacaccataagaaggaggaaaggagagtggccttattaccacacggtgatgatgaaggtcctgactctgcactagacctcctctactactactgcagaaggggggaggacggacacctcattactctcaggtgagggtagaagtccaggcttctgatatgggatgggggtgagggctcatttttgcccagtggggatgtgagactgcttggtgagggtggacgtctaagatccctacttgtcctttgcttgcatggatgggtgtagggatggaatatttatccgtggtgttgggtggagcagggaagttatgtctaaaagttctctctcttgctagactgcccctttcctggttctttggctagagagagcaggcttttcatctgtgcctattgttgtttctgggctgttgagcttctttggctccaagtgtgagatgagatatgtgaggaaaaaaatcgcaggaaactcaccactgtgttgtttctcgggtcttgagatccctagccaatctgccttctcttcacctttcagtcttcttatatcatcagttttacatataagggtttttagctgtatacagtgggaggcacagagaaaagtaaatctattccatcttcttggaagcagaagtctgcctccattagctttctaatacatattatttccaccatagattgtaggtatttcatagaacaatgttaattctgattgtcaagttagcaacatgaactatttacactctacccttttgccagagaatatgtgatgccaaactttctgctttccaattaccatcaatgctaagtagtgagaagtcattattaatggagtattaccagagagttcacagttcacagtctagtcatataaaaagcttggtccctaggtcaattcagactacaaaacctgaatgagaaattcttatgctaaaatgtgctgacagtactaagcccatgttgagcaacattatttttaaaaagtatatgaatactttttaatgttctaatttttattattttaggggtattattaagagtacaattcactacatctcacagcatccctttaagaggacaagggaagaaagaagttccctcagctttgtaccacaagaagctgaacaatcaatttattttaatattttaaaagttataaagctaataatttatttctttggctgccaggaatctcaggatcaaatttggtaatgacatagattttcatacccttgatttcattttgtttttcaattgagattttacttttactcagatttcctcatgtattgtttttccaggaggacagtactcattttggtacctgatcttatttatttcaggatcacatgggtgaataaatgtattaagaaaagacagtgggttcgtaagccctcaacaggacaggaaataaacctcaggtctcttcataacttgtcagaggaacttaatacatgctgccattttgatcccaaatggcctccttttcaagaggcccaaaaacgaatctattttttttttgtcacataacttacattgcatttgtgagatggagatttttaaaagggacagacaaacacaatgactacctggaggacggaagcaccactatggagaaactgaagaccactttcagcagagtcaattccaccagtagccaaaatgggaaatccaggcagagcacgagcaatggaggtcacagctctcaaagcaataggtctgattgctgtccctacacaaaatcagaataatcaatggttagcacactgaccacttgagtatactgtcttatattacttctattactatgatgtgatgacagcgtcactggacaaatttcaaattactttatctctgtttaagatgtatatacatatgtagtgtataaatgttatgttttaaagcatgttaatttgttaatggatgtttatttattttaaggactttgataccaatattgaatttagacatgttatacaagtaggtatagcaaacacagaattctctgtgcacacatattacatgcatattacaattggatatacagtaatgtgtaaaagattgcatagaatatttgagcatcagtggctcacgcctgtaatcctagcactttgggaggccgaggtgggtggatcacctgaggtcaggagtttgagactagcctggccaacatggtgaaatcccatggctactaaaaatacaaaaataaacattaaccaggcgtggtggcaggctcctgtaatcccagctacttgggaggctgaggcaggaaaactgcttgaatccacgaggcggaggttgcagtgagccgagatcacaccattgcactccagcctgggtgacagagtgagactctgtctcaaaaacaaacaaacaaacaaaaaacaaggaacagcagattttgaaaagaaaaacaatcccatatagtacatcagtagacatacagctatgttatgtttctttagagtacaaagcagatgttgcgaacatagactctgtaaaaaaaggcaaggtgctgatgaacttacagattccatgttgctttttatatgtacttcccacaatttgaaaaaaaatagggagtctaatccaatttttcacatattagaaagttttaatcaagttaaagagaatttactagaatccagtaattagagtgtatgaatttaattttttaatatttaattagccagacattaccagtatattattccctaatagtaataaaaattgtatggatagaaagaatactttggggctattttaaaaatgagtatattgtactaaagctactttgaattctcaaatgttaaacatcccagagtacattaatgctttcataataaaggaatataatttgatattcctggtgttcccttataagtcaggggtcctttaagcattttctgaactaaaggcagttcaacttatgcaagaatttgacactgccttaaaccagggcttcacaaacaacataaacaaataactggttcagcctcacgtggtgagttctttgtcatcacctccaccaccactagtcaccagcaatatcaatatgtatttactggagtgcttactctgaggtagcacacacagccttcctttaaaaaatggccagaacttaaaattaaattaaattaaaaaataaaataaaataattaaataagaaaagaaacaaaaagttaaagggctttcaatttgaaaaggctagatagcatatgattccaactatatgacattctggaaaaggaaaaactgtggagacagtgaaaatatcagtggtagtaaggagcgaacgggagggataaataggcagagcaaagaggatttttaggacagtgaaaatactatatatactataatggtggatgcatgttgttatacatttacacacacacacacaaaacacacttagagaatgtatctgttacactcatagaatgcccaacaccaagtgtgaaacctattgtaaagttcggactttgggtggttaggctataggtgtcaatgcacgttcatggattacaacaaatgtatcactctagtggggaatgttgataatgagggaggtcatgcatgtgttggagcagtggatatattgagtatctctgtatcttcctctcaattttgctgtgaatctaaactgctctaaaaaataaagtctaaaacagaggctgggagtggtggctcacgcctataatcctagcactttgggaggccgaggcagagggatcacctgaggtcagaagtttgagaccagcctggccaacagtttgagaccagcctggccaacatggtaaaaccccgtgtctacaaacaaatacaaaaattatctggacttggtggcgggcgcctgtaatcccagctacccaggaggctgaggcaggagaattgctggaacccaggaggtggaggctgcagtgagccgagattgcgccattgccctccagcctgggcaacaagagcaagattctgtctcaaaaaaaaaaaaaaaaaaaaaaaaaaaaaaatcggtggctttctttttatcctgttcatatctgtttcagataaaattgaacgtttgcatgactactgcttttgtactcaacacaaaaatgtttgtggaaatgtctacttgtggctcccacacctcaaacatcttcctctacatattactatagcattccttagttaggaatattcaatgctgacacttcaaaattcataatagacattttggatacaaagtattaagttgggcaaattagaaaccggacattaagattctacttctatattatttatcagtgattcctcacagtttttatgttttaaccataaaaaggctaatagtggacagaatttatagtgagaatacaaaaacacacatatatatacacatatcttcagttatactaaaagaaatctacataacaaaagttaaaggaaagcattttttaaggaaagctgtaacaaactttttgatagacacacagctatctctgcataatataactggcatagccaatacataccaacccaatggcttctttacatacacactactttgaagtaataaagaaatattggtttttttcctcccttatttagttgacccaagagagtaaatttgagctaagtagataaataatttatttctacctccactgttagaagactatcattaacagtaaggggtaaaatttcaaagtggtatacagggatttggccacatattctattgatattaatggacataaaaaggcaacacagctttgaaaaattaaccagtgacacttaaagggcaacattattacacaggtgttaaaaaaatcagcaaattcttattggcatttgaagatgttcaattaggtcaataagacattttccaatttatgcttttcttcctttctaacgcttttataatgtacctaatgaacagaaaatcttttcaaaaaataagagtattttttcaagttaagagtaactatgttctctgaggaaatgagatccaaaaaatgaagaaatgatctctctgttgctggactacagtaaattcagtttttatttccattataaacccagtttgattttttataactcaactgatttaatacaaaatataatctacctgttctcagcatttttatggggaatagttcttaagaatgacttcatccactaagaacggtttctagaaggaaaatgaaggtatataaaaagatctttctaaattgctatgtagaatttatttttagttttaaaatgacagaaatgaagtaataataggttcaagataaaaataaaactgttggtttaaagaaaatacatatatcaatgccatacaaaattgtacatatgccaattaaaatcataaagacttcctgaattacaattatcgagataaaggtcttttaaaattttgtcactgctacagtgattaatgattttagaccaaagactagggaggaagaagccagtgtgagaagttcaaagaatgtgtatgcgggctctatctttaaggaaacaacaaggtttaaatcaagaaattgaaatcctatacacttaattgaactaacaggtaacatgcaatttaaattaagccctcatctacatggggtggccagatgaacctaatggggaattcagttacatcaagccattctgcttcaactgtgtggaatcctccaataaaaatcaagccattctgagttcccacgttttgaaacaagctgcaggttcgaacaaacaaacgaaaaatgaactggacttatgagttgcaacattgctaccaagaactttgctttgcattatgtggctcttgtggtggactagactgaactgtaacttttggtcaataatcattctaggccctccatgtagtcataatttaaaatacaaatcagtgtgttgaattcatagattgtcttagataaactacacagaacattcttgaattgattcatgtttcagaaaaacattttagtaagccagagattttgaattaagttaatcaatctgattttgatgaaaagtatttttcttaagaaaatgaactctcatttgtcagatatcattttaaatacaatttcagaaatgctatcattggctataatattatatattgatatatgtgtattaatgtattatgacaatcaggttccttactcagtcttcatttatccattcatctgtctatccacaaaatattttttaagcacctatggctttttttttcctggttcatcagtttgtgtcctaactatatatctacgcttgactcacaaaacaccaggtcttatcattgtagtaggttatttcaagttaataatttgaatccagttattcattctctaccagtattccattagaaacaattcacatttgttagaacattatacattttataaatactattaatatgaattctatcaagaaggcaatttgaggatgaactagttaccaacatcagagagacaactgggccaactgttgaggttcaaatcttagttccatttataagctgtgtgactttgtgaaaatttttaaatcccaccgaatctcaattttgtcatctataaaataataaaaattgtaataacgtcttcatagagctgttttgaagaataaattacataatatatataaaaggcgaggacataataaaaattgtagaagtgtttgctgttataatttgtactgccctcaaggacaattgatttcagagtgagcatttatgtagtttactttgacattgccttctatgttcttgtgtgtttagtgatgcaattaaaaccaatttttaaattggagacaaaagcatgatgcctatgatgacagaactttatcctctgaaaccttaagaggaccatacatgtcccctcctttttctcttttcctaacagctgtcatttagcagtgtcataatgttgatgaagattactttgaccccaaaggaaaaaaagcctcaaaaggctgacatcaatatatttaagattttttttttttgagaagcaaaatgtccatggattttaattacaatatctgaactcaagtttattggtgaaaaggaggcagagatgtacttcgcatgactaaatccttgaagaaaaaaggaatttttaatgagcaagagagtgtggaacatatgctaaataactggaattttgaataattgagtttaattctgtttgtctttctccccctaatcatttgactcctctaggacagcgactgttacacaattaattgttagaactaagtccacaataaactccctgataatagctctagctggcaataaaacagaaattgggttataatactcattcgtgctcactgtgtatgcaaaaagaaaatgtagttttaatttgcttacattaattaaaatataatgaattaagtggataacaaattcattagaaattgaaccttgactgtctaattgttaacagttttaacaccatccagaagaaaaaaaattagtaaatcaagaatttcaaggatttaggaggtgagagattgatttttataacctacatataaatgaaccaccaacaaatttatgctttactaaaattaagtgtacaatgttaatgaagttaatatactaataaatacatgggacacacctatttaaaaataacatctttacacatggattagggtcctctgagaatatttgcataattcaatcagaaactgaagtactaaaaggatctagggttatatgtagagatgtgtaatttaaagagaagaaatggaaaaaataaagttgattatttgatgttattttagttttttcagaaaagctaaaaatttcttctgaaaatgttttaattttagttgaattttttatgttttctccaagtcttcctatcttcatagctatgtttttctgcttcataatgcattcaatatgttcctagtggattcatattaaataactcagtacctagcatgtgtcaggcatttatttttaccaagagaattaataacattcaccaaagagggccattctcctttctgaaagtgtcagctactgttactggaatgagtaggatcactcattcatagagtgatttccacgtgcagacactgaggcaggggcttcatgtacactgtgtactttaacccttgtaactctgaagctaggtgctgtcctctctattttgtacataaaggaagagaagctcaagctgaataaataacttatccagtgtcacgtagtttaaaaaggatgtaatacattaaaaataaagtctctgcgacatgaaagttcccattttcagttattattgagaagtgacaatgcagcaattaccaaaagaaccatctctggattatttttgcctaagaaaactagtatcagtacagactgatgctatgagaacacagaggaagtccaaccaattaggtgtaagtctcaaaccatttgctttatacaattgtagctttgagcaagctcctcaacttcctaaaacattggttttccctaattaaaaaacaaggacattaatactaataatattccagggagtttggatgtattagatgatacaactcatgggaaagacttggcacagtgcctagcttataatgtgtataagctaatattagtgtcaaagccagagaaaattgatcagaaaaataaacattcagctataacacatataaggataaacacttaatttttaagggttgttaatattcattcctagatataacatttggggttccttttgtaacccatatattatttcattggcttcaaaattatgaatattcatagcttgagtctatggtagtaaatgtgtgtatctgtgtgaataaatctttattagatttttaagtgtaatttgcaacgtgtgtgtgcgtgtgtatatatatatatatatatatatatatatatatatatatatatatatcttctaagtcttttttgaagaatctgttccattagtgcttagacacaaagttacatatacaacaatgttcctggaagtattactttctatagaaaaaccgtagaaaacaatctaaaggatcatgagtagttactctattaaataaattatagttcaccaagatatgatattccagaaaacctttaaaattgacacgcaaatagctctaatttataatgttaagagttaatcacaagtagcagagcaatatatatggtatgctcccattgttggcaaaaaagtatgtgattacatttagtatgtgtgcatgtaaatgcatataatgttgaatttcatactgttcacaggtatcatctctgggaaagggggtgagtcctgcagtaaagggattgaagacctttcaagtttatatatatatactttttattgttggattctttttgataaaatggtgttataatttacttctgtagtaaaaatatctatttttataatgttcctaaaattcaccttacgagaataagcatcatcagtatatatgatgtgacatttttatatatgagtgatacatacagtgattctatcctctgtacattacaaagaacatgtttggttctgtgtccaatattttagataaaagatctacaaacacaacagagtgaataggatgatctctcttgatctgtctttctcacacacatatcatatatatctatatagtgattaaaagaaatcctataaatggtcatcaaatatttgaaggataatcatgaaaaaaagggcttatcctatgtagcaaattggaacgaacaattcagcatacacgattggttttattattcttatttttataattaatttattgtaaattcagcaatgaaagcagctacaatggaacttccctattccttgaatcttgatggctacttgacagcaagatgcaacagaaagacttctctgtactacaggaaatattggattagtttttctcttccaattcaaaatctggggatactataacttattcttggtagtttaagagcaattttatatgctctatagttttccaacagataccagtgattaacttagaaaagaagcaagtatgagttaacttttaagattaaatatgttaaatataaatgctcctcttttgagtgctttctaattgacagatagtttcctatttatttttgcatacattgtgctggtcacattactatgaaatagatatttctgtctctatttttatagatgtgtaaactgagattcagcagggataaatgccacatcctcaagatcactctgttagaaagtatgggtccagtatttgaatccaggcctacctgactcccaacaccatgctcttaaccacaatgctatgctgcttcctgattttaagtgtctggatataaattaagctttagaaagaagagttaataataataattgttataattaataaagatatattatccaggtatgataaaaccataaaaatcaacattatagaaaaatagacattatattaattgttggataaaaattaaattagaagtagaatagctagtaattgtataactagagtaaccatatagcccagtttgcccaagagagtcccagtttattatacctgtatttatttgtaattacataatgtaacaatagctatcttcctttggtctaaaagtatcccagttcagatgataaattataaaatcatactagctataactaaagataattatgtccaagaataataggacaaagacaattacagaagcaaagtgaaatttgttttagaaccaaaaccaaatttatgaggagcttagaaactcactatactgtccaagactcaaaagatggcatgaagagctaaatgtctttaaatttgtcactagagagaaaaatatatggcatttactaggcataattagtctatatgtatgttctttctattttcaacctgtaggtggccaccacaagctacacttattaaacaactcattagtagcattttcaatactgtcatcttcagataattagcaatttatttaaataaccaatttctgtagaaataattgccatgaaatgccctgaacctactttttataaactataataaaagtgttaagataatccctgacatttgcaaatgccattagttcacctttccttttgatagtgctatggcattatgtttaaacaattacccgacaacacagcagtttaatgaaacagtacagtgagcacattcttcaatatggccagagaggacattcagatttagaaagaaatccagtgcgcagagaggtttacccagaggaaaaacacagctaaaagaaaaagaattactgaattaaggacattattgctatttccaagttggtttagtttccatggtagatgccgtatcatatgtactctctttggaaacaagaaaggagagttttacaagttgatttatgtgataggctggtgtgaactataatcatatatatctacgaatatgtataataccttcattgtattatttgctctaaaaccttgatgcaggaacaagtagtaaatttttcttactatcaaccttaaatgtacttttactttaaaaatggtgtgcactttcaaagtagagttattgaggaaacgcacaaatggttttacatcgcagctagtatttatcatttaaaatagaccagagttctaactcagtttcttccttgctattcagttccttatactactaagatccattgatgtgggattatacagtgtgtcttggttgcgagtggtaaaactatttgaagcctttataatttttaagctggtgtccacttcatatgaaaaaataaaattagaattcaaagccagtggcaatattatttttatggttagactgaaataacttgagaacctattaagtaccagttgctctgctaaattattcactcgttatttatatcctcacgacatcattacaagtcacatatacattatctccattttacagacatggaaattcaggctcaaggaattaaatagtatgtgcatgtaagaaaggcagggccgtgtggttagataatgcattacaacaataagacaattagtctgcaatatcaccataaaattcactgccgggtttgaatgtgaggacttttctttatttccagattaacacatgcctcaatctctccaaataagagcttctggcaatgctttttgcctacaattttaaaggtttacctataagtataaatagaagaactatttaaaaaagacatatttccccagccaagaaattattctcacctatgacagacttagtggacttgaagtaatatttctcatgtgattttgcttaaggatgtccagagcaaatgttacacagcataaaaatctcaccattctatgtgttttcaaaaatgattatttgagtaggagaaggaggaagattataatgacaatgataatgccgatgaccggagtttcattttactcttgggagaatccaggataacaagtgggcattattctgagaacatacagaaaaataaaaaagaggttccacatccattaggatcctattacttcttcctttggaaaatcacaatttcttttctctctgaaatcctgtgctctgtttactctgtgggtggttctatggccagggtgtccatggcagcacttgctgtactgtaaaaccattcctttcactctcagcaacacattctctttcactttacaaagaattacatgtgttaatctctatgctctgtgataaggctgtgtccctcagagtctactgaaacacaggctgtacagcagttgatggcgttttgttctcttctttggcctgtacaactctcaaagatgtggtgtggacaaggacatctctacctgggcccttatctgaaccctctgaatcaatgctcactctaaaactgaccaggcactttgaaaaagagagatcctactgtttagttgctctatcaattagttgacaataacatttcttcctaaatttcaatagggtaaaaaatgaaaaatcattttcagtcaaaattatttcttgtacccagcaccatggctgttgctcaaaggcagcagaagagatgtctcttctcagcaagcttataaggctgggtcaatgagataaaaaacatggacaacccatgttcacatgcccaattttgtgggtcagacaacagacactgctgaaacttagaagacaaggagagccaggaaatctgaggtggtctaggaaggctttgaggaagatgcaggacttacttcagttgggctcttgaaagataagtgggtaggtctggggctaaaaattaggatatttcaaactgtggcagagtttgggaacaaggtgagaaaaatttcagatatagtaatgaacaaatcatatttataaaacacgttaacagcaaaactaaagtagcctctcaggttgggaaatggtatacagtgcattacatagtgtagggatgttgcctcgtaggcaggaaaacagcctacccccagctctcgcagctaccaatatcaatttctatatggcattttactttttaaaatgcattaaaaaatattgacctagtataagaataaacaggtttaaatttaaacaaaatatcaagtaagggaagttcaaagctatttattgttaataaaaataatattcctattttaatagcaattgttaattattaataaattaataaatattgctatttactgccaataaaaatatttctcaggggacactaaagagaatctgtactctttatacatgtccctgtctgcagcctttctagagatcataaagttctttctagtctgatgaaaagtaatattaggatttttatcaaacagaagggataagaactacaactagaataatatgatccactttttcataatatagagagcttatataatggaagagaacaagtgttccactccattcaaccattcagtaactattgccagtaatgtgaattatcattttcacagatgcatctatacttttaacaaacatcataaatagtgcaggaatctgtagcatgtattaaaaagagcatatgatcaaaaaactaggaaaggaaaaagaacttaagactacattatttcagacaagatctcctaaagtattacctaaaggaactgtaatactaccctagagcatgaggatatggagcaatctggcaacctctcttaacataccacaagtcagctacttgccaaaaatgggaagctagtttcaagctgtgcatatctgtgtggcccctgagacccctgatgtttcagggctttggactacaagctgaggatgtgcctcaaccaaatggatgataaaaactagtagtgatttgtatagccactgagtaggcatgaatttctaatgtatctaatacagaaccaaatagaataaaatagaataatctatgtaaagcaggcagcacagtgacaagcacatagtaaatgctttaaaaatgccatcactacagtttctaaaaatataaaaggataataatagaacaatatgagcaatgtcatacaataaactcaacagttgaagtgaaatgcacaaattccatgcaaaacacaactaaccaaaattgagacaacaaaaaacagaaagtcaaaattaaaaatagatccataactattgcacaagttgaattcataataaaaaacattttcacaaagcaaactgcaagcccagatggcttcgctggtaaattctattaaactaaaggaaggaataataccgatcttacacaaactcttgtagaagatagaggaagaatgagccaatctcaactcattttataaagccagtataatcttgatattgaaacctgacaaataaactaaaggaaaataaaattatagaccaatatccatagactcaaatatctgtattaaataaattcagcaatatataaaaggtgtaaagcatcatgatcaaatacagtttatcccaggaatatgaaggtaatttgatatggtttggctgtgtccccacccaaatctcatcttgaattgttaactcccacacttcccacgtgttgtgggaggaacccagtgggaggtgattggattatgggggcgggtctttcctgcgctgttcttgtgatagtgaatgagatctgatggttttaaaaacaggagttgccttgcacaagctctctttttgcctgctgccatccatgtaagatgtgattgctcctccttgccttccaccatgattgcaaggcctccccagccacatggaactgtgagtccaattaaacctctttctttggaaattgcccagtctgatgtatgtctttattagcagtgtgaaaatggactaatacatggtttaacatttgaaaatcaattaatgtaattcaccaatcaactgaataaaagagaaaagacatatgagtatctcaaaagggtacagaaagtgtacacaggaaaatctgaaatccatccgtgatgagaactgtaagcaaaacaagggtgagactatcctcaatctgacaaagaacatctataaaaaaacctatagctaaaatcagactttatgttaaaaaattctttctctatatactcttcatactttctatatactctattccatatactcacaagaagcaattagaaagttaaaaaatagtattcacaatagcaccaaaaagcaacaataggagtacatttagaaaagatatgtaagatctgtacactaaaaatattttgtaaaatatttctgagaaaaattcatgatacttcagaaaataaagagacatactaatcatagacttgttgactcaatactgttaagatgttaaacttcaccaaattgatctgtagattcaacacaactcaaaacaaaaatccaaaaaggtttctttgaagaaactgataagctgattcttaacattatttaaaaatacaaaggatgtagattagcaaaaacaatcaggaaagaaaataactcaaggacacgatttcattttaggacttgctttaaatttatagtaataaagacaatggcattagaatatacgacaaataagtgaaagagaacggagtcctgatatagtcccacaggtaaggccaattaatttttgaccaaggcaggaagtcagttcaatgaggggaaaaaagccattctaacaaatggtgtgagaaaagcaggatatttttaagaggaaggggggagaaaagaaaagaaaagaaaggaaaaaaatgaaaccatggcctctacctcacttcatatacagtttttttaaagattcaagatgaattgtaaatctaaatgtaaaacttgaaaccataaagttcctagggagaagaaaaggagaatatttctgtaaccctgaattaggcaaaaatttcatggaaaggatgttaaaagcaacgactaatttaaaaaaaaaattgataaactggacacttgaacaaaatacatcattaagaaaataaagaagccaaagtctagaaaaaaatatattcacacacatatattttaaaacgaactcatatgtaaaatacatgaagaactagaaaccaacagttaaaagattacaatagacaaaatacttgaacaatactttttaaaaagacatacaaatgatcaataaatacataaaaaagtgttccacatcagggaactcgaaattaaaatcaccatgagacaccattttaggcccacaggaatggctaaaaatccaaaagactgataacaccaaatgttgataacaatgtggaacaaaacgaactctcacatgctgctggaaggagtataaaatgataaatcacggccaggcatggtggctcacgcctgtaatcccagcactttgggaggccaaggcgggcggatcacgaggtcaggagttggagaacagtctggccaacatagtgaaaccctgtctctataaaaacacaaaaaataagccgggtgtggtggtgtgtgcctgtaatcccagctactcaggaagctgaggcaggagaatcgcgtgaacatgggagacggaggttgcagtgagccgagatcacgccattgcaccccagcccaggcaacaatgcaagactccatctcaaaaaaataaaaaataaaaataaataaataaataaagataaatcactttggataattgtttgacagtttctttaaaaaatgacatacatctatcctatcacccagcaatttctttcctagatattcactcaacagtgaaaacagaactaaaaaagtatatgtacaaaaatgttcatgacagccttacccataacagctcaaaactggaaacaactgaaatatccatcaattggagaatgaataaacacattttggtcaatcagtagaatgtaaactactagcaataaaaatgaaatttctactgatgtatgtgacaatattattttaaaaattatattgaacgtaaatgaggccagacatgtcccctactcacacacacatggaagtagcagggaagaaaggtaagaaagagaaagagagaatagaatgaatattatttagtttatatgaagttttagtacagataaaaagagtctatggtggtataagtctcagctggagatggagaaattgactagcaagcaacccaagagaactttctggtgtgaaggaaatatcctctgtcttgtttcagattgtgttactacagatgtgcatcattttgaaagctaacttatctgaacatatatcatatctgtgtattatattgtatttaactatactccattaaaaataaaaatatatgaatacataaataagaagtagcaaaatgtccatctcaaaagtgagcatctcctatatgaatccacttctaaaaaattcttttgatggtcagaatctttcaaatacttaattttatgaaatatgaggacatcttcccatttgcaaatagaaaatgaatctgtggcagggcacggtggctcatgtctgtaattccagcacttggggaggccaaggcaggtggatgacctgaggtcaggagttcgagaccagcctggccgacatggtgaaaacccatctccagtaaaaatacaaaatcagttggtcatggtggcaggcgcctctccagcaacttggaaggctgaggcaggagaatcgcttgaatctgggaggcggaggttgcagtgagccgagattgcgccattgcactccagcctggccaacaagagtgaaactctgtctaaaaaaaaaaaaaaaaaaaaaagaaagaaaaaaagaaaaaaaatgaatctgtgagcttatattttaaaggtgaatgggactgaagatcatcatctacagtacatcatgtaaggtaaatcaatgtcaacttagatgacccagtgagagcaatttttatggtggtgttgctcttgttaatgttcgtaatctccatgaaattttcttgagagcaatgcttttaaagaagccacatatatcacatataagcacgtacacacaaacatacacatacacacacacacattgtcagtgataaatcactagttactaagaataaggacacatggagtacaaaatgatgagcatataaagacaggtattacggctagactatacctctaaatcgtaactcttgaattagccaggcatgctaaaaatcactctatttagaaaggcacagcttcaatgaaccaaagaagcagtttggccctttgctgactgtagtgctaagtgagaccccagagccaaatttcaaaaaatgccatcaactgatcacaagtattgttaacatataatgagaatgtctgtttctgcactttatgcccaaattggtatttgagtatatctttacctctccaaaacgagagaggagtcactcaagggtgttattcctattaaaaccttgtagtcataaacttaacttcccagacaaatctttaaggaatatttggctcatagttatgtcaagtctatggtggatttgtaatgaagtatcctttctctatttgctattttttcaatctttaatgttttctgatgaaatttcaggctcttgtcaaattgaggtcattactttgtctactggcatggatatgcaggcaaattggccagtgtgcaaccctggatgactcaacttattgccaaatggcagttagctaacttccatttgcaagaagaggagacagcctattgtcaggaccaacttggtggggaaaggatatatagtctgtgtctaatgcacatatctaagcaaaatgtgatgcatatatttttccacattcgtagatgctctttcttgtttttttccaatttatattgttgacataagtgtctcatcgtccaaatgcttaaattgtgtataataattccaaacagcattcgaccattcagatttgggcattgggcatcacagatatgttaaatctagttacagaggcagagctagagcatggtttccatgccttgaggggagagacatttttcagtaacctttgccaaaaccgctatatactgtttttctcaacagagctcagagactcattgtaattgtgtagaagtcaacagaaatcatattaaactataacactttcaaattttttcaagtatatttgcaatccagtgtaaatagggccaatggtcacaatgtatatatttttggaacactaatatttgttttactctaggcaagtgttttcacaggtagtaactggtatgaaaaagatctgctttcactctagaagattatttattcataaacttcgaaatacaaatcataagactcccagaattctaatttactaaatgctgaatatattatgaagcagttcttaaaatttaaaatttgaaaatggaaatgtattgaaaaagtttcagaaaaaaatgatgtatttcccatatccagcacaaactgaactagagaaacatattatgattgccaaaaaacgggctatcactctaaaggctgtaggcaaacaaaatactaacaagtttaattattcacaatggcacatttatggagagtataatgtcacaatcaatgattacaagcccacacaaatagcactgtaataatcctacaaggcgtgttcagaagtgaaataatttagaatttgaaatcaatagcatttatagacattggaaaatgtcaaatggaaaacgaatgccagtatttgtattctttctggagcatttttacttctcagcttttaattattctttaaaagattttttagtatctgaaagcaaaagcaaacatttccctttcatgtctcaactaactctttcaataaacttagatatgtgagggtattgttttatgtatggaaaaatgagaagtctttgtgagagctaaggttttgctaagtgtttccctttaatttcccttctcgtggcatcgttcccttgtgccattctcatcctccatctcacaatgtttttgttccattcatttcccatcactattagcatttaaattccggttttggcacaaaaactttccaacacaaggtattactttgacaaattcttaaaatactccttgtaattagagacagggtaaattggatgagaagtatatagggattctctccactatcttttcaacttttctgtaagtctaaaatcattaaaaaataaacctttatttttaaaagtttcccctatataacacttggattcttcttgctcttataaaaatatcagtttacctatattatttgggaaaaacaaggacacaaacttgtgaatattgaaaataattcttaaaaatataacattcatagctattttaattaattgccatttcctagcaaggaataatagcaataacaataactatcctttgttgaatgaactaaatatgcacacagaactctattaaggcttttattaatattacttaagttactttatctaaatctcacagaatctccaggagctatcactttttatgctaaaaattgttaaatatcttgtctttataagagtaactggaaggtctcagattctacccaaatatgttgactcccaaactagggccgtttttcacaaacattttgccttccttcaataagttgatatttgtatgtacctattggctctaggcattgcactgtacatatactttttatatatatacttatttgtatgaatgctcaaaaataaccctgcaacaagttgctattaattctaaaaacgaaaggaaaaatcctgacattttctagtaaaagctgttctagttacgaaagcatttaactgtcaactctggtctttgctgacacttttttagatttctgaaaaaaaaactgtatttaaccatttgtccattaatggagtgatgtccaatcaccttatgtaccatcaaattacctatcaacagaaagagaaagagaagaaaatttaatttcaggttactccagaaactatggcaaccaggctgtttggcagccaaagggtgtaaaatccagattagatagatggatgtatttacatattcacttttacattaaacagagtggatgacacatccctgtataaaacctattatttaaaaacttcaagtgaaaactgttaaaataaatggctcatgacttatgaagtgttaaaataaacgtttatttcaacactatacatgtcataagccatttatttcaacactccctacttcagaagacttacccaaaacaagaagaaaagatctcacttgctaagtgtatgtcaagaggccaagacgcagaagataaaaccgaagttttgatgctagagctttggtatgtggaagttcagatcagaaggtggaagaggaggtttgatgcttaacacctggtaaaagctctgtggttgtggtaaactgttcatcatcaccacctacattggcttcatttagacatcacgtttatcttaagtcattctgagagtttagggcatgcctgagtatcaaattatgaatgaaatgcactgtttgaggtgtttctgcaaagataatatatgttttattttatgtccccacttattagagaaggctcatgtaatcaaagtcttcagggagcaaagcttcagggacaaaggcccagtttcataagcataagtgcatacacttatacagcacttcctatatgacaagctctagtgtaagtgttatacaaatattaagtaatttaatcttcacagtgtttaggagggtgatatggtttagctgtgttcccacccaaatttcatcttgtattcccacatgttgtgggagggacccagtgggaggtaattaaatcatgtgggcaggtctttccctgctattctcatgatagtaagtctcatgagatctgatggttttataaagaggagttcccctgcacaagttctctctctttgcctgctgccattcatgtaagttgtgacttgctcctctttgccttctgtcatgattgtgaggcttccccagccatgtggaactgtaagtccattaaacctccttcttttgtaaattgtccaatcttgggtatgtctttatcagcaatatgaaaacagactaatacagaggggtaggtatttttatttttgccgtttttttttttcagatgggaaaacaaatctagagtggctgagtaatctaaccaggggaaactggtaagtggtggcaccaggattttaccccaagcagttagcgccagagtccacgttccttatccctatgctaggttgctgactttcagcagcagaacagcagactatctcatgctctagaagtcatgtgggcttgagaagtcaagttcatcatttcattttcgggcagggctagcccaaatgggtgacaatttctctcctttataaacaagatctcctagatgaaaagaattaatgctatttctataagaaattagtattgactgatgactgatgatagttgattatgacagctttcagttttgcctattttaagactttatgttcctaccaaaagttgaaggcctatggttgaagtgggaacgtctgacagtgactgaattatttccctccaggatgtcttttattgcccgctaataaaagcgctagtaaaacatttccattgttaagcatacccaataatagcagtctttatattctgaaacaatgctgtatagctcccaagcttctctctccctcccttcctcatccttccttctctctttcttttatatttccctcttgatatggtttggctgtgtcccccctcaaatttcatcttgaattgtagcttccacaattcccatgtgttgtgggagggacccggtgggaggtaactgaatcatgggggtgtgtctttctcatgctcttctcatgataatgaataagtctcatgagatctgatggtttcataaggaggagtttccctgcataagctctctctttgcctgctgttatccacgttaagatgtgacttgctcctccttgccttccaccatgattgtgaggcctccccagccatgtggaactgtgagtccattaaacctctttcctgtataaattatccagtctcaggtatatctttattagcagtgtgagaacagactaatacacttcctcttatttctctaacatctcttctttcctttatctcccatctttaccttacctctcccctctcctcagacaccttagcactaagaacaaaattaagtgtggattgcttaaagtccctcagtctttataattttataaatctgtcaatagttggaacatatgatgtaaaatcatgtagtctatctgtaatacatatccttgtccacaaaccagactttaaaatatctacacccttcctctgcccacccaccttcccacttcacactacgcaatgattaccaacaagttcctttggaaatcacaaagccaaaaattggtaaaaagaaatcagaagactcagtgcactgtgacatacaaaaaacaatgtgcttttaacataccacaatggaaagaaaaattctgagtttttttgattagaacatttggcatttgaaagaagaaaactaaattattataaaattatggaatgtactcaacaaaaaagtgacataattaaaaaaataataggttggataatatgaaaatatactatatactcacctatttataaaatctctatatttgatatcttgttattagaatccaaactactccaactagtaaaacattcagatgtatttatactacataaatgagacctatatttttataagtgacacctgaaatgtattttctgagagcatattttgatatttactactggtactaaagtaaaagtacatatacatacgtatatatatatatatatagagagagagaaagagagagagagcacgtgagttatgtaaatatacatataccatatctctatatagtgtgcatatgtatatgtgtgtgtatatatgtatacgtatatatatatttgtgtatgtatatgtgtatatatatggtacaagtatatcttcccagctattttttcaatttaaaaaaagtttcataccatcaatttgaaaaaattctaaatttaaaattaatttttatacaaatttaaactagacattaaaaaccaaatattttcattcattaaataagtagacatttattgaatgccagctatgaagcagctattatgtttggagctggtgacataaataggagttagacattatccctgtctttaagaaatgtacactctagctaaatgaatatataaataacttattataatgtatgttaatgactccagtaaaccttagaaaatgatcatgacaaatcagagaaaagtgtattgtactttgtctagttgggtcatctttacttgaagatgaaatatgaactatgtcttaaaggataactagcattttgaatgcagagaaggaatggagggaatcacagataacggcatgagcaaaaggatacagatctggctggaatgttaggtgtgtcgtagggcctagagtaaagatggattaggagggagaggaaggagacaaggctagatggagagtggggcagatatttctgggacacacactacagcctccttgaccacctctaattcaacagcagctcttctagtcagttccatgtcagctctgactgaccccaagaaaacagagccccacttcatgctttgctaaacttctttgtaccccctgtcccagggcctctcctgccaccacaagagcctactaagcctgtgcttccaagccacaaaagtacaggcaagtgaataaatactttcagggacagcccttaggctgctcccgccttccatccttcagggggacaattctataaggcttctgcacactttctaggagttcataattgtgatctaaaagtgatacctgcttaagttgacttttgctccttctttgtctcatatttcctcctccctgatgtctatttcccaagatcaactcccaaataggccactttcatccaagtccttgtcttcaggctttgcttttgtaagaactcaaactaaggcagagatgcaatgaggcctgtttgtgaagggtcctatactctgcattcagcattctggacagtttcttacagaagtgagagggcctctgagaattttgagcaaggtagttaccagataagattgtattttggactttgtatatgatggtggtgttgcataaggaccagaaggacaagaaagtgaaagtgattagcagatggtcatttaagaattgtctataaacacaagggcttggactaagtcaagcctatataagatagaaaatgacataaaagatttcattcacattcggagatggactatataaaaccttgtgactaattagaaatgcagagtaaaagggtcaacagtgtcaagaggactcaggttaatgccatttactgtgataatttttaaagtatttagaggataacaaatttgagtttgggtaaatacctgaggctaactggatggaaaacagctgagctacttaaaaacatgaaatataacctattacttatgttttggtttgccatgcatggtatctccagtactgtaaaactgggattctataaatgccttatttataaataggatcctagagctcaaagagattgtgacaatgctgactactagaaagagtttgctaaaatgttattcaattgaaaactgtgtatgaactttaggatcataaaaagcttggtatacattctcctttcctctcttaacagcaaccacaaactggaatttaccgattaaaaatattattatttttgagtcagagtcttgctctttcacccaggctggagtacagtggtgtgatcaatagctcattgcagactcgaacccctcctcaagtgcccctcctgcctcagcctcctaagtagctggtaccacaggcagaaattgaaagaccagtggccaaggatcaaagtattcaatcaaggttgggcagtgacttaggattagcagatgagatcaggtggcataatgggaggcaaagtcagtgtataaggtcaagatggtataatggaggcaagaacttcaaagactggtgagtgaaaactgtacaataatgatttggaagaagcagtgaaataataaaacaattatagtaacatcacaaattttgattacatacaacaagaatttcatttcttgctttcaattttcatccttcttctatatctgtacaagtcagactagccagactgaaattggaagatgatatgggcaatggttgacatagatagatatgtacacatctctttacatatatacataaagttacctttcaccactgtcattcttggcagataaaacactataatcactttatagttgaatggcatataatgcaatgaaaggtcttcacaagaaaaaaaattatgttttcacctttttactttctttagcagtgattagttccagaaatataaggtatcatcacttctcaaaaagcgctgtaggttataagattgctcttctgaagttggcaacatgtaataaatgtgctttattcctaaacatcaatcagtttcaagaatggcacttgcttgtaaaatggtaataatagaaatagtcagctaataagtactataggcattaaaacactggatgacaggtgtgaagacttcttgttataaaagaatactctcttatataattatggttttataactagttacatcagtttctaaatatttagtttttaagatttctgtatcttttttggtaatgaaacttatatgatagtattctgtactatcatatttataacaaataaaatatagagatatagccaaaaaagacaatgaaagtattctggagaggtgtgatggctgtaggtcatttaatctgaagagtaacaaatttaaataattattaaaagtgttgcttgagaagatattaatttgttgtataagtatacaattgaaaaatatttgtgtaagtcttaaaattaccataaaattagaatgtttcagtaatttatgaaatagttgcatggataaactttattgaatgtgtggtttagtagaaacaaacaaaaaacactcaaatacaaaacaaaaggacacatggtgattttcattttccaaagcaaaacttcactctgtgtcaaataaacagaaaaatcaggttcctaacctaaatggagttatattttgctggagagaggatctgcagactgaacataactatataatgtacgaaatctaaatgccaggggaatgtagcagacagtccagagggagttcagagagcaggcaagttccagaaagtacatggaggcagtaagcattttaagtacaaaatcagataaatggaccacaggcatatcaaacttcagaaatgttttcaaagaaggcatgcaagtgagaacacatattttgttttcacagaatgaagagataatcgttcaccataagtaaacagtttgtaaatgatcactgaattgtagataggggtgtaaatagttgctggattgtgaagacttagtctagaattgtgaagacgtatgacaaacacatgacaaacaagtcactggcaaaatgtctggagttctctttccatgtagcttttcgaagtagattcagaaaaggcttttaatataaatttgaaaggaaagaaagggaaggggagctaatggatgcctctatgcgctgggcactgtgatggacacctttaactttagaatacattatttttatgacagctactttattgtaaatatatgtatctgcaatcacatctatccaaaattaatgtagagatccaactgcacaaatatgagaaaattaagtatcaagtgacacttgctagtgtggatgaagttatgatgactttctttgagaaaatgataaaagactatgcatctttttttttttttttttttttttaaaaaagaacgatttgtgtctctctcctaacttgccaagcaggaaaattcaaagggaaattgtgccaaatgactattttatttaaagaaaatagtttgagatggcagttccaaaattacttctgaaggtagcaaagggtatgaatttagttaagagataaaactgtgtttttagaattgagaacttaggctaggcaggcatttggcatacattagctaatttattcctcataatagctctatgaagtctgatttttggcattatcttcagttcacagtgaagttactgaggtcatcagctggtgagtgtgtttctgacattaaaactccgtaagtttttttcatcattcatgtgacttctacctgataattccttaaacactaaactatttgctgtttcttgaaaatatcataattattcacacctctgtgtgatttctcctgctattcctactgcctgaatttttttttgtttttgtcttcttctctttgtttgttaaggctaataccaaatattacatcctttggggagcactcctagaccatcctcaatcaccagattcctttctttttgttctctctagcatgagtgggaacaacatcttgaataatagcaatacccacctgcctcatcttttaatgtgtgagctccgtaagggcaggagaaatgtctagttactactttgactgtaggtatatccattggaaagaaaataaaggtaatctttacgcacactgggcatgaccagataagctccttaagttctttgagtcttggtttcctcatatatgaaatgaggccaatggaagtatctatctcatgtgagttagatgagcgattgcatgtaaaatgctccacatagggttgaacacattgtaagcccttaataaatgtcagttcttaccaacatcatcacctttatcattattattcctagtaattaacaattcgttcttcaacttcctggacaataaaaatgggttacattttccactaaaacttgaagacaattaattttaactttttaaaattctaaagttttgagagtagtaatgaaaaataatctttatttcttttatgatctatattttgtcttaacttctgaacgaagcctctacagaattagcagtttgggatatattttcttttaccagaagctatataaagaacaatataattcttcttatttctttttctttttttaggaggtgaaaattataagacattttctgatagagaagataatatcagacttaggtctacagcaggttcattctggatccatgctgggagagaaaacaatgaatgttacacttcatttataatttccactgtgaacatgataagggctagtatattctcaaatcaaattaatccacaattctagcatttaagatacagtgcaaatccctaattcaagtataaagtatcacctacaaagccaaaataaatggggtaagataacagttctcagtgttgggttatagtgtcaatgcaagacttgagctgtgttaattcaacaagcttgatcttgattgccaaagcatgcttgtcaatatttagctcccagagggcatgtcaggggcctttacagaaactagcttaaatacaaaatactatagcaggatttgtgatccttttcctaatactcagattaaactgctgattttctttcttttagctttttaaaccaagaacgtgttttccatactcctatggtaacaagaagagaagaaattgcatagaagaattgtaaatgctattattagagttccttgaaacccagataaaattctgtcacatgaaatcactataaagcttttatctgaggtctgaaataccatttccccactatgattacaatatagaaaaaggcttggaaaaaaatgttaatctttattcaaaaacaaatgtaatacagatgagatgatgggtaatgattcccacaaacttaaaaacaaatagtttacaattttaataactctgcacttagaatcttctgctacaaggatgctgtgaggttttgaagcttatatagccattattatttattatttaagggttgaaccattaaaacaattacacttaagaaaatatagtgggaatcagtagtacactgatgaaaacctataccctctatggtgattaagtataatacatgatatgaaaaatagcatttttccaaattaatacatttgtttgccttctaacttttattcctcattagatatcaattaattggacatctacattctccttttcactgaacctgacaaaacattctatgagattgggtatggtgagattctgaccaaaatatttccaaaacaaacaaaataaaccctaccaccacaacaaaaacatgttaaacacatacttcagataattgaaaaattacccccttcatttgatgatcaaaattttaatatatgtcaagtacttataacatggctgaaaatagcccttgatattatcttttttcttttatctatttttttctaaaataatgactaaagataaaatcagatcaatgctgcaacaatgagaatcaggctgaaatggaagagccagatcatgatctagattcttttggttacctacagatagctatgactgccaattctgaatcttaatagcaaaattctgtttttttttttttttttttttttttttttttggacaaagtcttactctgttgcccaggctgaagtgcagaactcattgcagcctcaaattcttgggctcaagcgatcttcctgcctcaccctctcaaatagctgggattataggcacacgccaccatgcctggctagtatttttttgttttatgttttttgtttctaatttttagtagagatgaggtcttgccatgttgcccaggctggtcttgaactcctgagctcaagcaatcctccctgcttggtctcccaaagtgttggaattacaggtgtgagccaacccttctcttcccactttatacatttctgaattgaaaattccagtgatttgtcgaaacaataccgtttccattaatcatatttgttttactaagctaagacaaatgcataagccacatccctaaatcctattttaacttttacacagtaataaatttttccatcattgtccctaacttaagcttcctaaatgtcagctgatcttcacaattaccatattttatagataataaattgtgctcagatggatcaaaacagcacaattcaacaccacaaggcaaagctaatttatatttaaattgggactcgaacctgggtctgctgactacaacctttttgctgtctttatccacacatcagatatttcttgatcaaggcaaagcttaaatataaaaccactatgacttcgagacctgaaagtgtttttgttttcagagaaatgttattcctcagcatgtgtcaaagatatggttatgagaaagacaaaactttatagttttcagttatattttgccttgtcccttcaattttaccccaatagatagtaatagcaagactgtcccgttcatccgtggacagtgccattattagatactgggaatcctcgttataaattacatcataccactttcaccttgtttatcagactcctgcctcactgatacttgttgtttcttaaattcccaagctcatggtagtaggtcctttgcatgaccttttccctcttcttggtgttctaaatccatattattgcatgattggcactgttcatacaagtcttagcccaaatgtcatttctcaaagacatcttctctgacccctaatctaaagtcccatctctttttctatcacaattataccacctagttttgctattttcataacagttagaggtatttgagattattcttatgtattttttattctctcctccccacagcaatccctgcttcctgtctgctcaatgctctacgctcagaatttagaacagcacctggcatatggtaggctcttttacaaatatatgtttaatggataaataattgaatcagagcattttaacatctagatgtaatatatcctacaagaattgttttaagaataacatttgtctttatcagtcccacctgtgggagtttgaatgtggtagaatttgtgtcattgtgatgtacaaaaaatcttattatctgttttttattatgtagtgtatagtttttatatcactactgtttgagataaatgtgaccttttaatcttcttattaaacttttaaatacaattttttctttaatcattccaggtctctgactaacatgctcaatttcaaacatgtactctatctactcataagttagaaaattttgatactctctacttagatgactaagtttctaagaaaaccccatcactctattttggtctaaatttgattcctttactcagaagtttacaaattaaactttctatatgagatgcattctacagcattttaattggtaaatacattgtgctttaagtaaaggtaaaaattacttttaaagtcacatgaatttagacaaatagtactacacaataaagttactgctgatcaccaggttttttagctaatagggacatctagaaataaataaacttaatctaagtttcacaataattagctcataatatttttagtagaatatgaatttcagggatatcctgtgttataaaatctgtgtcatttgttcctttgagttcagaagggtattaataaatgcccctaggcagcagtatccaattggcttagcatatcaagggagaatactaactagagaatgaaaaatagcacattagtgttcagaatgctcatctattaagagaagatacgtctgcaccatggagagagggtacaaggacatcaagacaaaatctaggagtgctatctaatatcaattaaacaaatcattgctgtgtcctgcagttcagggttctgcatctttggtgtcttaatctgctgtatgctgctataacagaatactatagactgggtaatttgtaatgaacagatattcatttctttttttattattattatacgttaagttctagggtacatgtgcacaacgggcaggtttgttacataggtatacatgtgccatgttggtttgctgcacccattaactcgtcatttacattaagtatttctcctaatgctatccctccccctgccccccacctcatgacaggccccagtgtctgatgttctctgccctgtgtccaagtgttctcatcgttcaattcctacctatgagtgagaacatggggtgtttggttttttggccttgtgataatttgctcagaatgatgacttccagattcattcatgtctctgcaaaggacatgaactcatccttttttatagctgcatagtattccacggtgtatatgtgccacattttcttaatccagtctatcattgatagacatttgggttggttccaagtctttgctattgtgaacagtgctgcaataaacatacaggtgcatgtgtctttatagtaacatgatttgtaatcctttgggtatataccccgtaatgggatcactgggtcaaatggtatttctagttctagatccttgaggaattgccacactgtcttccacaatggttgaactagtttacactcccaccaacagtgtaaaagcgtttctatttctccacatcctctccagcatctgttgtttcctgactttttaatgactgccattgtaactggtgtgagatggtatctcattgtggtttttatttgcatttctctgatgaccagtgatgatgagcatttttttcatgtgtctgttggctgcataaatgtcttcttttgagaagtgcctgttcatatcctttgcccactttttgatcaagtggaagaaagggtatcagtgattgaagatcagattcatttcttacagtttcagattgaagatcagattcattttttacagttccagaagctgggaaatccaaggtcaaggggcctgcatctggtgagagccttcctgctgtgtcatcccacggtggaaggcagaatggcacaggcgcacacaagagagaaagagattgaactggcagcctcaagcgcttttataatgggcattaatccattcatgagggtggagctttatggcttatcacctctcaggaatcaccctcatgaatgggcattaatccattcatgagggtggagacttatggcctaatcacctcacacctcttattgctgttgcattggggattaagcttccaacaaatgcttttgggggacacattcaaaccacagcattccaccatggtccctcaaaatcatgtccttctcatatacaaaatatgttcattccatcccaatggctttaacccattccagcacgaactcctaagtccaaagtccagagtgtcatgaaagtcagatatgggggaaacccaaggcacaattcatcttgaggcaaattcccatcagtctgggaaatcgaacaagttatctacttccaaaaacacaatggtgagacaagcataggatagacattcccgttccaaaagaaagaaataggcaagaaaaaaggagtaacttgtttcatgtaagtccaaaccacaagaagggaacattaaattttaaagctagagaataatatgttttgactctatgtcccacctcctggacacactggggcaggggttgggcccctagggattgggcagccctgtttatggctttgatgggttcagtacactcagcagctctcacaatttggcgtcttatgcccgcagttctcctaggctacagttgcatgctggtggcaccacagttctggggtccagggactgcctcactcccatggctctactaagtaatgtcaaagtggggattccctgcagtagtctcactcctgcactctgctgtgcattgccctagtaatagctctttgcagtggctctgtgcctatgacaagtctcttcttagggacccaggctaaccgagagatcctttgaaatctaggtggagggtgccatggccccagagctcctgtattctatattcttgaagaattagcactatgtggacactgtgaaggtttgcagcttataccttctggagtgatggatcaaggtgcccctaggattgcttgagccactgctggggaagctgagggtgatggacaaaaattcagggaacaaagtctcaagatagtgcagggcacctaatgctgaggtccgatatgagcccctgtctagaaaccctgccttcaatgtcctacctaacttgccttgaagatctcagaaatgcctccatggtcattctcccatagtcttgatgaataaaacctggatttcttctatccatattaatctctttagcaaacagtcgcttagccacacacttagtattccctcctgaacacattcttttattctttatgtggctaagttgagagtttttcaatgttttctgttctgtttcccttttaattataagttccatctttaaaacatttctctctctcattttactgtaagctgccaccatatagcaccttgaatgctttgttgcttagatatttatcctgccagatgttgtttagatagttcttcttaagttctgtcttccacgaaatcctagaacatagacacaattctaccacatttttttttgcaactgcacaaggatagctttttactcaagtctccaataccacattcgttatttccatctgaaatcttatcagaatgccccttaccatccacatttctacaacattctgattatgaccacctaagtaatccctaagaagatttaggctctccctgtagctcttgtcttcttctgagccctcaccagaattgtcctgaaagctctattcatggaaacctaggctttttctagccttctcctccaaactgttctagcctctacccgttacccagttccaaagtcatttccacattttcagatatttgttatagcagcagtcacacttctcggtaccaatttcctgtcttagtccattttatagtgttttaacagaataccaaagactgggtaatttataatgaacagagatttatttcttatagttccaaaggctgggaagtcggtggttgaggtgctggctgattcagttcctggtgagggctctcttcctagcttggagatggctgctttctcactgcgtcctcactcacatggtagagagagagctctgatatctcttcctcttcttataaagtcaccagccctattgcattagggacccacccttatgacttcatttaactttcagcacctcttcacaggctttatctccaaatacagtcacattggaggttaggaggttagggcttcaacatatgaactttggagggaggggcacaattcagtacacagcgctcaatatctttccaagtaaattacttcatcagcaaatttatgataagatttaattgcccaaattccctctgaaaagcatatgagattatgtcacatcatttggctcaaatgaagaactgtaaactcttccatatttcaggtgcttttcggagggacataggttataagcaccacgaaggcctggggccatgtatgtttccttcatgccattccagcagagtggcatatagaaagcactctatttgttaaaggaagagaggaggcaagaaaagtagtaaagaaagcaatagaatcactaacaatttcccattaggagtctaaattcataaacaaccggagaatgggtttagtcttcccaaaggaaagatatatggtcatcttgcggttgagaggcatcataatattccagtagaatgtgtatagactataattttttattcttccctaccccaatctgtgttcttgcaatatctcaaccaagtgctgatatttctcatattcaagctattcctttgtgttaaatctagaaaaatctaattaaaacacacacacattttctgtgaaagatcattaactacaacatttacaccattccccattcatatggacctgtgctctaaaggctgtgagagggtaaaacatggggctggtaagctctgctgcaagtgtggggccagaaaatatttcatatataaacaattgctacataaggtagagtttgggagaaaaatgtttgtctcaaatgaagaaaggtgctgtgaacactgggaatttgtctgctaaaagaggaagtaaaagtgagagggacaaagataaactttgtctggttatgttcttcaagagccatccttgcctatttaaacagtttaaggagaagttagttatgtaagttctctcacaaactcttacatatttcgagcaaatttattcaggaagatttctgctcttaatacctgcctcttttattctttccccaagtgtttattgagtgcctactactacataccaggtactttgctaatgcaagatttaaaaaatgaccaagaggacatttctgtgctgaaagaacttgcaaactgctaaaagagaaatgcagtaaccacacaaaatgataagtcctttgacagaaacacactgaaagtatgtttcccatcaaaggaagcatcaaattcagctaaagaattcatagagaaggtttgttggcacattgaaggaagctgggatttccccagacaagagataaggcacggagtgtggggagcatggtgcattagagagtagaacagttccctctgactggagcacagctgagcctgggggcaggcagggaaagctaaggatagaaacgttcttaggaatgagcttgtggacatcattaacaaggattttgaaaataaaagaaaattaaatgtagtgtagagaatggacagaagggagagaaataaaataaaatcaggaagaagttaattgcagtattcccagagataatcttgtggaattagacaaaaaggaccagctcagaaaaactttaagcaagtaggttctttgggctttagagatcaatcagatatggcaatacttatcaaagcctcacctgtcctcttagaagaggtaatgtgtactggaggaaaaattgtaataaagatcaaagagagattgctattttaaattcaacctttttcaagaaatctgcatattctccacattctgccgatattatattttgaaaaccccataaaagcatgttttgctaatgcagattaaaagaaattactagggcataaatatatagatcattttcaatttagtccctactcactactgttttgtaccttaccacatcctcaaatagctgcattctcctttctcccacttggtgaactattgaatcacaatatccaaatggaaggacttccacactttgaataattgatctcaagcatgttccctgatgatttgacattcactctgttcttctccctgaagtatatttatatcaataactgcagcttcagttgcccttatatcacagtgttcctttttaagagcaaactgataccgtaagtaattgctagcctctttctgaaaaattttattctttctgcaatttgaacttagagcaacagactttgtcaaaggcaaaccagcacatttttctcttttaaaaacacaagttttgaacgcctgtgaaaggtctccattcaatttgacactcagccaagtcctaggaaaataaaactcacagtcttgtttactttttctctactttttctccaacttcctctatattttaaaacatattttctggcctcatgaataaaaacaaacaaaaatgtggcagagagcacaagcatgaaagttaaatttcagaatgggctacatttagctattctgttgcttctagtctgactctttatttgcacagcaattaatcagctatggtatgtcttttaactgagtaaacgatcatcaacctctcctaaacatgttaagaagttcatttccgtctgaattgtcctgacaaatactaaaatagataaccttaataaggcactaatgagatcattataactagttttgtctgtatttaaagtacagatttaagatcttcattaatgattaactactggaaaactttgttcaatcccttgagttatttttaatctctatatactataattacatatattcaatcataaaactttccatggtgctgaacacaattgaactttgaataagaacaagtacgttacacatcttggctgtttaaaaaggttaatctttaagtagattaatgacatagtgatcttcactcagttcaagctttttttctttttgactgaggaaaagatacgttactacaagctatttcatatctttctgatggaacttacatgaatgactgctttagaatattgaacaatcagaaccctgaactttctattataaggtgtctctgagatcagataagtaggatgtggcctatcactggtctttattttcagttgtgctaaaatgaaacaagtgtgttttctcccgtcagtttcagaggagagtggatattaaatgttaaatcacatttaagctgaagtcaatgtacaaaactttcaaccctaaagttgcctaagggaatcagaaataagggcattttacgggtgttactataaaattaaagaggagacagaaatgtgggatgtttcctttcattaaatgccaaatagttatttcaaacaacttgtagatgactgtattttaatgttatgacatacaattttcaaaattaaatgtgttttaagtcaaatttgctaatagtatccagcaaaaagataaattttagaaacataattctctaactgttcaggcctttcaaaatatagtttgccatgggcccaacaaggccaagggtgaaacgcaatattttctgatcctaaaatctttgcaaaaaaggaatgcagaaaatcaatgcagaattatataaaatatgtttgaggcacagactagctcttcatctatactccaactaaactactccctctcacaagataccactttttaatatagtacaattacctccatactgactgcaaaatggcagttaaacctttaaagtgtaaatctttgcttttgtgtgtttacctgtcatggactttaaacagtgtggagagaggactaaggaaggtggtaagctatttataaattggaaagtctttttgcatttatctaggaatatagacattgtcaatatgtgattgaattactgcaccagttttcctggaggatttgtatgtttattgcttttttgtaagacatttatccagctctctcaatcctgttctctttcttgcatgagttcacacatattaaaatgcaagtgtcttgcttgtctgatatgtcttttgcattatttgaaaccctgaagccccaatatttcttgatatctgtacaattctgaaacaaaattatttagtaataatattccagggataaggcaataatgaaatgtatatgcaacaaaaagttcacaagccatcatttcaattttcctcttgaattttcagggtaaagttgaaggaaacatttacttttgaagaaagaacaaaactctaaattattatcatcacagcctgtgaattattctttgatgcctattgtgctaaataggagattttatacaacataaagttaaggcaatatttactttagcagcttacattttaaagaataaaaacgagaaaataaatatgaatttggatatatacatctaaattcaaggaacctagaacatgatatggtttgtatatttgtcccctccaaatctcaggttgaaatgtaatccccgctgtcagaggtggggcccagtgggttatatttgggccatgggggcagatctctcatgaagggtgtggtaccatccctgtggtaatgcatgagttctagcaatctattatttcacacctgagccgcttgtttaaaagagcctggcatctctcttgtgccctctcttgccatgtgacacatctgatctgctctccctttgttttccccgatgatcagaagcttcctgaggtcctcactagaagcagatgccagcactatgcttcttgtagagtctgcagaacctggaaacaattaaacctcttttctttataaattacccagccttgggtattcctttatagcaaggcgaaatggactaatacaaaataatatgaaccaaagtacaaatactcattcatgatgataaagcagaaaccagcatttactattaggttggtgcaaatgtaactgcagtttctgccattactttcaatggcaaaacgcgcaattacttttgcaccaacataatatgttctattacacaggaagttgctccaggttgtcaaaaagtgatcagtgctggttggtaaccattgtatcctagtgtgtgggtctagggatcagttatatgccaggcaagtctctgatcccctgaagttcacagataagaaattatatgtagaatatgatataaacacgagagagatgcacaggatgcataagatgcatggaatcaggggtaagggcttctaaagtagtttggggagtgtaaggaaaatattggactgagaagctggttctaagggtagaaatgcctctgtgtctaaggtagcagtatgcttgtaggtaccataggtatagaagcaagagcaaccttggcattaggtaaaagtgtgagtagctcagtatggttgattatggcctggggcagtggcaggggatggcaacagaaaaggctggagatgtaagctgggacaaaatcatccagagcatggaataccatgactaggtaacttttatcctggaatcatattctttcttcaagttttagttaaaatgttatctctcccacaaagtcttccctgatccttccagtaagaagtgatcactcccccatggagctcctacagatctttgtttgaattgctcctttgacaggtaccaaattttctactgcaataggtaatggagtgaaaagtataagaatctaggattcagagggcaagaggttctactcccaattttgtcactttgcagtggtctatttgcctttgggcagatctgttcaccttattttcctttacctgtaaactctgcgtaatagtagttacaaacatttgtcattcagggttattatgagtatgtgaaagtggctttagaaattttgaaatttctaaaaattgaggtgtttgaatatatgtcatctatttcctataagaatgcacacaccttaaagggagcaagatttagattctagaagaggtggataatagtttgccaattatttataagcctaaaaccttgaagattaatttatctcaatccttcctctttccaggaaatcttccttcagttcttttccatgataagtcagcttcctgttagcttcctctctccttgaggcatagacatgtgcatagctatctcactgcacatggcttatcatgccttctcctgatcttcttcctctcagcttcttttgctggatcttcttactcttcctgttcataaaatgctaaaatagccattggacctcttttttttctttatctgtatgcatttcttagtttatctcaacaggttccacaactttttataacatgtttatggcatgaaggttcaatttatgtattcagttctttcttctccttgaacttcagggtcaaatatctaactagttaatctatatcttcatttggatgtctgataagatgtcttaagttcaacatatccaaaaagaactattctttcccaaggctgatgtccagaatggtgtttcctaggttttcttctaggactcttaatggtcttatatttaaatcttatgactaagttctcaaaagcaattgcaacaacaacaaaaattgacaagtgtgacctaagtaaactaaatagcttcagcacagcaaaagaaattaccaacagcttaaacagagagcctacagaatgggaggaaatatttgcaaactatgcgtccaacaaaagtctaatatccagaatctataagaaacttaaacaagtcaaccagcaaaacataaataactccattaaaaagctggcaaaagacatgaacaggcacttctcaaaagaagacatacaagtgggcaacaatgaaaaaatgaaaaaatgttcaacatcattaatcaccagagaaatgaaaatcaaaaccacaaagggttaccatctcacaccagtcagaatggctattaagaagtcaacaaatgtgacacagcaagactctgtctcaaaaaaaaaaaaaaaaaagtcaacaaacaacagatactggtgaggttgtggagaaaagggaatgcttatacactgttggtgagaatgtaaattagttcagccactgtggaaagcagtttggagatttctcaaagaacttaaaacagaaccagcatttaatgcagcaatctcattactgggtatatatccaaagggaaataaattgttctaccaaaaagacacatgtgcttgtatgttcatcacagcactattcaccatagcaaagacacggaaacaacccaggtgcccatcaatggtgaactgaataaagaaaatctggtacatacacaccatggaatactatgcagccataaaaaagaataagatcatgtcttttgaagcaacctggatgcatctggaggccattatcctaagtgaattaacgcaggaacagaaaaccaaatactgtatattctcgtttataagtgggagctaaacactgggtatacatggacatatagatgggaacaacagacacttgggactaccagagaaagggaggaaggaaaggaggtaagggttgaaaaacaactcactgggtactaagctcactacctgggtgacaggatcattcatatcccaaaccccagcatcacacaaattacccatgtaacagacctgcacgtgtacccttgaatctaaaatgagagttgaaattaaaaaaaaaaagagaacacaaaaaacacaaaacaaacaaataaacaaacaaacaaaatgcccctcaaatcagaaatgaactattgatcctcctcccttactcttttgccataaagctgttctccagagtttacttaaaatggcactactgtttgttcacatgctcagcccaaactatttgaagttatttataattccctttcctcttgtatcacacattcaacccatcagttaatcccattgaccttctctaaaacatattctgaacacaacattctccctcctccaattcctccattgctactacactggtctaaaccacaactgtctcttgcttagattcctgaattagctttaaaaataattgccctgtccccattcttatgctgtatagtctgtctgctacacaacagccatggtgcccatttatttagaaattgaaattagatcatataactaccttaacaattagaataaatcccaaaatccatgcagggcctacatgatctctggttagtcctccaatctcattgtcaactattcactctcctattcaacttacttcacaccatgcatccttattgctgtttctgagcattctactatatttagccctttgtctttgggatttctgatctatttatttagtttgtgattgcctagttcaccttatgtgactaactctgactaatgtgccagtgttaagtgtttactgtcaattcatctcatgactcagtctgttccaggaaatgcaaagattaaaaagaatttctcttgattgcagcttaatattttccttattctaaaatgtttctttctgtcttgagcaatacctaactactagtaactaccagaaatgttagtgaaagtttgcctactcaggggcttcatctcataagaaagtaccagaaaagccaaaagtaatgcgccagtctataacaaatctgtgtttttgataatctaatttttaaaagttacatttactttctgactgccccttatcacattacagttcagggcagaacaaccagaaactacagaaagtaaatggacagggaaagagatgtgccattgttgttgataatgtgccggcacatgactaagctgtgatagttcaatgtttcttaatgttcttaactcaatgcctagatttaaaaagtcacagatcagagctgcaattatgccaaatacctggtggttttattaaacccccaaacagatttcctgttgttgctcccctctaaaagtttcaaaatatgcagagaaaaatgaggacagccaaatgaggataatctgatgtgtacagttgaaaataaagcatcatttaggaagaaacaaagttttctgttatgtagtaatgatgcaaagggctagagaaatctataaccctgaattctgacagtgcagataataatctgtttttcttgcacaatgaaatttactatcagtgtatgaattttaactgtgtgtagatatatatgcacactctaacacatatatacataaatatatattacactcttactaagacaatggtatttcgtaaaaattttttttttcccacagctctttgcagacactaaacttgagcttctgaatggcagaaattgacttttaaaatatatgacttcttaaaaaaattcaactttgattctagattcaggtgacggacatgcagatttgttccatgagtatattgcatgatgctgaagtctgtgatatgaatgatcctgtcacccaggtagtgagcatagtggtgaatctgtaagacattagattctgatattacaatttccaagggattgtttttgaaattacattaagcataccccatactttgtttaaacatggcagattccccacacatatatgagaagttttggaagatgaaaagcagattgtaaaatgataactgacttagtagaaaaaaaagaacattcaacatgtagaactcccaaaaaggcagctaaagacagggtactggagagcacagttcaagcagggaggcacagtgggtgaaatgtgaagactgtctgaagatggtatatagagccaattggaccccagtttccatcacaaccctgtgcaatcaggtttctagtggtccactggagacagagatttgtttgtttgtttgtttgtttgtttgtttacttgagatggagtctggctctgtaactcaggctggagtgcagtggtgcgatcttgggtcaccgcaacctccgcctccggagttcgagcgattctcctgcctcagcctccgagtagctgggacaacaggtgtgcatgaccatgcctggctaatttttgtatttttagtagagatggggtttcaccatgttggccaagctggtctcaaactcctcaccttaggtgatccgcccacctcagcctcccaaggtgttaggattacaggcgtgagacagaaatttatttttatagaagtgtactagagatactccagatatcaaaactagtggaaggctgtaattgagacaggaaactgaaagcaaggaaatgaaatgaaagtctgcatattgaaagctgggactaccattcatccactgatcccttttttacagaaaggcacattgctttcatgacggagatctgaggatccttctaagaaattgtttatccccagagaaaagacctgaagatactcacatttgtcagccacagtaaaaggaagagcttaccactcaatctcctctgcaataaagctccctagctgttaaatttcactcacatactcaaggcttccaatcaactttttaatatctcacacttaaaaactaaattgaggatgtcttgaatctccagacatttcagaagtctttttttttacatgaactagagaaaccaaaacaaataatcaaaataaataaatgaataatgaggcagaagatatagagatttatatacgcattgaagggaaactgtaagaaaaaaaccaaacatagctaacatcttcagagacagtacagaatgaactgcatccaaaagataatgcaatcaagaagaaaccaccaaagaaaatgatatcaatatgctgaagagatatctgtgctcccatgtttattgcagcactattcacaacagccaagatatggaatcaaactaaatggccatctatagataaataaagaaaatgtggtatgtacgcaatggaatactattcagccataaaacagaatgaaatcctttcatttgtggcaacatggatgaacctgcagggtattacgttaagtgaaataagccaggcagagtaagacaaatactgcatgaactcactcacatgtggaatctgaaaaagttgatttcatggaagtagagagtagaaaagtggtattaagagactggggaggggtagggggagcaggggcctggataggttagtcaatgaatacaaagttatagttaggaagaaacatttctgttgtttcattacacagtagggagattacagcaaataacaatatagtgtatatctcaagatacctcgaagattttaaatcttatctccacaaagaaatgataaatgcttagagtgatggatatggtaattaccccgatttgatcattatacaatgtattcgtgcactggaacatcactacacaccccataaaaatacaattattgttcgattataaatacaacattattttaaaaactatcaaaagcagaaagagttgtacaaaagttaaaatataatgatcaataaaaaataagttacaggtatgatatcaaagaaatctcccaaaagagaaagcaaaattcaaataggagaaacaaaacaaaataaatcagaggggagaatgactaaaagaaagaatggagaaaatgggaagaaaaaatgataaacagataacaccagagaatttccagacctaaaaataaaattttccacatagaaaagagctgagagtaaaacaagaaattaaaaggaaaatccaggttgtgaaaaccagatcacaagagataaagagtagatcctaccaaaaggataaaacaatttgaaagagagaaaatatataaatatatatatggatgtgcatatatataatttaaatcaaagagcagataacagatgagatcagccctctctataactgatagaagaaactagaatattggctataaatacttaattaaaaattgttttcaatataaaattttatacccaatcaaattattaagtatgaggatagaataaaaacattttcaaatatgcaaattttatctaaagtttctcagaatgcttagaatatctcaggaagttatcaaactaagtcccagaaaaataagtaaatatactaagggtgagaaatgtatgggatccagaaatagagggtttaacacacataagctaaggaacatccctaaataacatcaattaggacacacagggaataattttaattttttcccccatgatgtataacaaagtgcaatatcatgagtagggtataaaattatctacctcatcattatctttgaattatatattgcctttaaatattttaccaatttgatactcaaaaatagctcaccattgcttcactttgcatgtcttcgcaaactgagttttaagagtttttgcacataagttattggcttttttccatctattgctcaaataactttaaatatctatctctattttaagccagagcagctcagagttgcttttattgacttaccacttgatattatgtttgatattaaacctacactgagggatgttgtaagagaaaacccactggtgttactgtgttgactacaaagcttttgttgaggatacagctattttatgacatcatactctctgagtgagaagtcatagaccttgattctgaagcaattgcattattgttgtcttatgaacactgtttcatattcgtcttctaattttgttctttttttgatatataaaaaattaaagacaatatgcagtcaaatatttgcaatattttcactgatatttttccatttattttatctttacaaagctttcctttaccattttctctttttttcagagatgcagaggttgtttaatattaggaaatacattaatattattttatgactctaatagacaaaagcagaaaatcatatattttctagatacactagtttatttgactagacagaagctaatttactagtataaaatttttaaaataaaattcaacttttttcttgccaacatttattttaggttcaaggggtacatgtgcaggtttgttacatgtataaattgcatgttgcatgggtttggtgtatagagaattttgtcacctagttaatcatcataggtagtttctatcctcaccctcctcctaacctcctctctcaaataggccccagtgtctattgctcccttctttgtgtccatgtgtacttagtgtttagttcccacttccgagtgagaacggtatttggttttctgcttctatgttaatttgcttaggataatggcctccagcttcatccatgttgttgcaaaggccatgatttcactttcatatgctgtgtagtattccatggtgtttatataccgcattttctttattcagtccactgctgatgggcatctaggctggttccatgtctttgctattgtgaatagtgctgtgatgaacacatgtatgcatgtgtctttatggtgaaatgattttcaaataggataaacatacacctatcttttttcttttttaatagtttaatttagtacaattgttaaaattttagtctactatttattttgatacatagtatgaagaaaagttaatacttagacttttttctaaataaatagctaatttatccattgattatctgtttaataaaacatcttttgtttccctgacaattggtttgagtgtcttcttttatatgcgatattcttggaaatacgaagactatttcagagttctctgttccattggtttaatctactggttcttgtgccagaaaacattgtcttagttattataattttgaaattggtttaaataatctgttatgtatgtcctttttcacctttcatctaggtgaaaaagttgcttagtgattttttcctgtttcctcttgctcttaaattttaaagtaattttatgtgtcttagaaaaaagctcatttcaattttgtaattgacttaatttgaaataactgccatattcatttctaatttgaactaaatgccatattatgagtcttttattataactcaatttaatataactcaatttgaaataaacgctgtatttactatgagtcttctactataagaacatattgtgttttgtcatatattcaaagctgcttctctatgctgaagtagttatgttgtttctttcagtcccatatattatttaagaatgagtgttttatacttcgtttttgctagtttgaatgctggtgtataggaaagcaattgtttgtgtgtctactgtacagtggaacactgggtccaagagtataagccttggaatcagtcagatctgacctcaagtaccaatggacctcaggccttggtattgtttttctcatttataaaatgattctttgtgaaagctgcctaactcagagcctggtacacaaaatctccttaataaaaggcagccgatataataccttaagcatcaccattatcatctcactatcttatactttaattaattctgagatttaaattaactcttcacatttcctaggtatatgaacagagcatctctattaacaataatggtattttctagaatgatacgtcacttctttcatgttacatgtgtcacacataactttcacaacaatattaaataacaatgttcatggtatatatctttgtcttgacttttattttaatggaactatttttaatagtaaactcactcattaagtgtgagtttgacttttggtttatgatgtatattctcaatattaatatttatcataaactacttttagttttctaagattttaaacagaaagtgatactgaaattttagaatgagtttccagatcatttcaaaagaattaagctttttcatattggatacagttatatagtatattatgttaataatgttcataatattaagccatctttgcattcctggaatattcttctttggtcaggatggctatatcttttaatgtgctgttgaatttaatttcccagcaattaatataaaattaattgctagtcaattttttaaagcatcaaataaaagttttagatcaatttcatttatgaatataaatgtatattcattattctgctcccccactcccatcctgctacttcatcatgaattcattttgggttgtctcattgtcaccttctctttcataattttgattactctgtcatatttttctacattttctggagaaattcctatggctatccttcacaacacattcaattttccatgatctcaattctgctctgtcacaacagcaatgtgtattttatttgtgctgctgtatttttgattctgtattgtctttccatttcccacgtattttcctatccattctgtatcttcttgtttcaacccagtgtgaattgccctgctttttctgtctgcttgtttgggaaaatccccttttcaggactagagacacacacaacattgatgctaacgggtctggatcaaagccaaattggcagaatctagcagatttttatgggactctacaagactaaaggtggagggttttaacttttcctccttgccttgacctctaacactctgtatagaagggatatatgtaaactacaaaattcacagtaaatagacaggaaacttgaagtctctgattctacttgaagatcatggcttctgaaaattagacctcttaaacattaggcattgcttccaacaactgcttgctcgcagaaacgaagagaaatgaagaggcttccttcactgtaggttctatcctatggcatcagaacaagagcaatcctgcttgccttaaagtaggtataaaagtgccaagtgcttcatttctctatttttatctattcgtagtttagaaaacaaacacaaaaaataaaatctgaaccacttattacagtatccttataattgctctttgatgtatacaatcatatatacataccctcagaaatacctggtcagaaattaggagtagtaaagaaggactactactgctgaatcccatcactcaaagtttaaatccatatgtgaagttcactaaatggaatatttgtgaaaatttcttggccattctgacaattggctgaaagtcaactttttattgttcctttaattttttttttttttttttgagacagggtctctttctgttacccaggctggggtgcagtggcataatctcagctcaccacaacctttgcctcctaggctcaggcaattctcccatctcattaaatttttgtttatcctctatgtcttcatatattttagtgagacttttggagagtccacccgagtgtccaatcacaaacctaaattccttttaactggaccatttagtccatttacatttaaagttaatattgttatgtgtgaatttgatcctgtcattatgatgttagctggttattttgctcattaattgatgcagtttcttcctagtctcgataatctttacaatttggcatgattttgcagtggctggaaccggttgttcctttccatgtttagcgcttccttcaggagctctttagggcaggcctggtggtgagaaaatctctcagcatttgcttgtctgtaaaggattttatttctccttcacttatgaagcttagtttggctggatatgaaattctgggttgaaaattcttttctttaagaatgttgaatattggcccccactctcttctggcttgtagagtttctgctgagagatccgctgttagtctgatgggcttccctttgtgggtatcccgacctttctctctggctgcccttaacattttttctttcatttcaattttggtgaatctgacgattatgtgtcttggagttgctcttctcaaggagtatctttgtggcgttctctgtatttcctgaatctgaatgttggcctgccttgctagattggggaagttctcctggataatatcctgcagagtgttttccaacttggttccattctccccgtcactttcaggtacaccaatcagacgtagatttggtcgtttcacatagtcccatatttcttggaggctttgttcatttctttttattcttttttctctaaacttcccttctcacttcatttcattcatttcatcttccatcactgataccctttcttccagttgatcgcatcggctcctgaggcttctgcattcttcacgtagttctcgagccttggctctcagctccatcagctcctttaagcacttctctgtattggttattctagttatacattcgtctaaattattttcaaaattttcaacttgtttgcctttggtttgaatttcctcctgtagctcggagtagtttgatcgtctgaagccttcttctctcaactcgtcaaagtcattctctgcccagctttgttacgttgctggtgaggaactgcgttccattggaggaggagaggcactctgctttttagagtttccagtttttctgctctgttttttccttttccccatctttgtggttttatctacttttggtctttgatgatggtgatgtacagatgggtttttggtgtggatgtcctttctgcttgttagttttccttctaacagacaggaccctcagctgcaggtctgttggagtttactagaggtccactccagaccctgtttgcctgggtatcagcagcggtggccgcagaacagcggattttcatgaaccacgaatgctgctgtctgatcgttcctctggaagttctgtctcagaggagtacccggctgtgtgagcagtcagtctgcccctactgggaggtgcctcccagttaggctgctcgggggtcaggggtcaggcacccacttgaggaggcagtctgccccttctcagatctccagctgcgtgctgggagaaccactgctctcttcaaagctgtcagacagggacatttaagtctgcagaggttactgctgtctttttgtttgtctgtgccctgcccccagaggtggagcctacagaggcaggcaggcatccttgagctgtggtgggctccacccagttggagctttctggctgctttgtttacctaagcaagcctgggtaatggcgagcacccctcccccagcctcgctgccgccttgcagtttgatctcagactgctgtgctagccatcagtgagaatctgtgggtgtaggaccctccgagccaggtgcaggatataatctcctggtgcgccattttttaagcctgtcggaaactctcagtattagggtgggagtgacctgattttccaggtgccatctgtcacccctttctttgactaggaaagggaactccctagccccttgcaagacacagactggcaaattagataaagagtcaagtcccatcagtgtgctgtattcaggaaacccatctcacgtgcagagacacacataggctcaaaataaaaggatggaggaagatctaccaagcaaatggaaaacaaaaaaaggcaagggttgcaatcctactctctgataaaacagactttaaaccaacaaagatcaaaagagacaaagaaggccattacataatggtaaagggatcaattcaacaagaaaagctaactatcctaaatatatatgcacccagtacaggagcacccagattcataaagcaagtcctgagtgacctacaaagagacttagactcccacacaataataatgggagaatttaacaccccactgtcaacattagacagatcaacgagacagaaagttaacaaggatacacaggaattcaactcagctctgcaccaaggggacctaatagacatctacagaactctccaccccaaatcaacagaatatacatttttttcagcaccacaccacacctattccaaaactgaccacatagttggaagtaaagctctcctcagcaaatgtaaaagaacagaaattataacaaactgtctctcagacaacagtgcaatcaaactagaactcaggattaagaaactcactcaaaactgctcaactacacggaaactgaacaatctgctcctgaatgactactgggtacataatgaaatgaaggcagaaataaagatgttctttgaaaccaacgagaacaaagacacaacataccagactctctgggacacattcaaagcagtgtgtagagggaaatttatagcactaaatgcccacaagagaaagcaggagagatccaaaattgacaccctaacatcacaactaaaagaactagaaaagcaagagcaaacacattcaaaagctagcagaaggcaagaaataactaaaatcagagcacaactgaaggaaatagagacacaaaaaacccttcaaaaaattaatgaatccaggatctggttttttgaaaggatcaacaaaattgatagactgctagcaagactaataaagaagaaaagagagaagaatcaaatagatgcaataaaaaatgataaaggggacatcaccactgatactgcagaaatacaaactaccataagagaatactacaaacacctttacacaaataaactagaaaatctagaagaaatggataaattccttgacacatacaccctcccaagactaaaccaagaagaagctgaatctctgaatagagcaataacaggctctgaaattgtggcaataatcaatagcttaccaaccaaaaagagtccaggaccagatggattcacagccgaattctaccagaggtacaaggaggaactggtaccattccttctgaaactattccaatcaatagaaaaagagggaatcctccctaactcatgttatgaggccagcatcatcctgataccaaagccgggcagagacacaatcgaaaaagagaattttagaccaatatccttgatgaacattgatgcaaaaatcctcaataaaatactggcaaaacgaatccagcagcacatcaaaaagcttatccaccatgatcaagtgggcttcatccctgggatgcaaggctggttcaacatacgcaaatcaataaatgtaatccagcatataaacagaaccaaagacaaaaaccacatgattatctcaatagatgcagaaaaggcctttgacaaaatttaacaacccttcatgctaaaaactctcaataaattaggtattgatgggacgtatctcaaaatcataagagctatctatgactaacccacagccaatatcatactgaatgggcaaaaactggaagcattccctttgaaaactggcacaagacagtgatgccctctctcgccactcctattcaacatagtgttggaagttctggccagggcaattaggcaggagaatgaaataaagggtattcaattaggaaaagaggaagtcaaattgtccctgtttgcagatgacatgactgtatatctagaaaaccccattgtctcagcccaaaatctccttaagctgataagcaacttcagcaaagtctcaggatacaaaatcaatgtacaaaaatcaaatcacaagcattcttatacaccaataacagacagagagccaaatcatgagtgaactaccattcacaattgcttcaaagagaataaaatacctagggacccaacttacaagggacgtgaaggacctcttcaaggagaactacaaaccactgctcaaggaaattaaagaggatacaagtggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaagagagcccacatcgccaagtcaatcctaagccaaaacaacaaagctggaggcatcacgctacctgacttcaaactatactacaaggctacagtaaccaaaacagcatggtactggtaccaaaacagagatatagatcaatggaacagaacagagccctcagaaataacaccgcatatctacaactatctgatctttgagaaacctgacaaaaacaagaaatagggaaaggattccctatttaataaatggttctgggaaaactggctagccatatgtagaaagctgaaactggatcccttccttacaccttatacaaaaattaattcaagatagattaaagacttaaacgttagacctaaaaccataaaaaccctagaacaaaacctaggcattaccattcaggacataggcatgggcaaggacttcatgtctaaaacaccaaaagcaatggcaacaaaagccagagttaacaaatgggatctaattaaactaaagagcttctgcacagcaaaagaaactaccatcagagtgaacaggcaacctacaaaatgggagaaaattttcacaacctactcatctgacaaagggctaatatccagaatctacaatgaactcaaacaaatttacaagaaaaaaccaaacaaccccatcaaaaagtgggcgaaggacatgaacagacacttctcaaaagaagacatttatgcagccatcagacaaatgaaaaaatgctcatcatcactggccatcagagaaatgcaaatcaaaaccacaatgatataccatctcacaccagttagaatggcaatcattaaaaagtcaggaaacaacaggtgctggagaggatgtggagaaataagaacacttttacactgttggtgggactgtaaactagttcaaccattatggaagtcagtgtggcgattcctcagggatctagaactagaaataccatttgacccagccatcccattactgggtatatacccaaaggactataaatcatgctgctataaagacacatgcacacgtatgtttattgtggcactattcacaatagcaaagacttggaaccaacccaaatgtccaacaatgatagactggattaagaaaatgtggcacatatacaccatggaatactatgcagccataaaaaatgatgagttcatgtcctttgtaaggaaatggatgaaattggaaatcatcattctcagtaaactatcgcaaggacaaaaaaccaaacaccgcattttctcactcataggtgggaattgaacaatgagaacacatggacacaggaatgggaacatcacactctggggactgttgtggggtggggggagtggggagggatagcattaggagatatacctaatgctaaatgatgagttaatgggtgcagcacaccagcatggcacatgtatacatatgtagctaaactgcacattgtgcacatgtaccctaaaacttaaagtataataaaatacaataaaataaaccctaaaaaaaaccctaaattcctatatttgaattactagtactagaatgatcactgactaaatttaacctaccaaagatatatatttttcatttcattctccttaaaacaaacattttaaattttttttacacaaaattataatgcgttataccccacattaggttttattttttttcctttcaaagtggggactaaagttgcatgtatcagaatcctctgagatgctaattgaaaatatatatgcttggccttaacaaacatctactgaattagatgctctaattccaagaatctgtgtatttgaaaagctcctcaggtgactattatcatactaaagacttcagtgacctctgctgtattataagctacattggtctgttctcatgctgctattaaaggcatacccgagactgggtaatgtataaaagaaagagatttaattcactcacagttctgcagggctggggagacctcaggaaacttacaatcatgtcagaacgggaagcaaacatgtccttcttcacgtgttggcagcaaggagaagcgcagagtgaagtgggggaaaagccccttataaaaccatcagatattgtgagaactcactcactatcatgagaacagcatagaggtaactgcccccatgattcaattacctgccattgggtccctcccatgacatgtggggattatgagaactacagttcaagatgagatttgggtggggacatggccaaaccatatcacaagcctatataaaaagggtgaaactaaagaaaggtctttgagagtgatttcaaataatgtacaaggaacaaacacccagacacaaacacacatgcgtgcacgcgcgcgcacacgcgcgagcacacacacacacacacacacacactatttctacaaaatattaccacaccctcatctagtataagcttgctattaaaacaagggtttggggatctgggaacactagggtaaaaagatatttcaacaacacaaggcattgttgttggcctaattcatttctattatgttttcattttaactacttaatagagaaattcataatttcattttagtattggagtaaactaaaaaaaagaccaaatgtttggaactattgaataaaaatccaacatagaaataatttgatccattaaacctttggcatctgccttgaaaagtacatatgtttctttgtgttatttctcagtatattaatatgagaaatgcatgaagcacagaggttaataggaatatggagaggtttactagaccacttacagtgtaattgtgacctgtcattactgtgaatttttttaaaacagtgattaatctcagtgttatatttatagattgttttcagtcaatttttttgtcaagtacaaaagtgactatatattttcatcctacaatatgttaagacattacaaaagcttaatggaataaattaatacagaatgagcaatggagaaggggcagctgaagcacagtgcttaagtgtacagtatgaagagtcagacagtagagattcccatatacctggataccagctgtgtgatgttatagaatttacttgacctttctgtgtctcagtttatatttcaaaaaagcaggcccctaattgtgcccacctgattggtttgttgtactgattaaatagcataacatgtgaaaagctcccagcatctgacatctaacacatagtaagatggcctatattctattagctagaatttcttactaagtttccaaagctcaacagcaaaatcaagatggctggcaaagattaaaagtcagtccaggccgggtgtggtggctcatgcctgtaatctcagcactttgtggggctgaggcagatggatcacctgaggtcaggagtttgagaccagactggccaacatggcaaaaccctatctctactaaaaatacaaaaattagcaattagccagcatggtggtgtgagtctgtaatcccagctactcgggaagctgaggcatgagaatcgctcgaacccgggaggtggaggttgcagtgagcagagatcacaccactgaactccagcttgggtgactgagtgacactctgtcacaaacaaaaaaaaccagtccaatcactaaatgctcctgcttgtatgcaactgaatattaagaataaaatggggtttcttacatgtctactatgtccctgaaactttcataaattctggaggagtcgatatgaaggaaacaacggctcttgcttttaagatgtttataatccaaacaggtcagtcatcaaccgaatgtgctaaatgaactgagactaattaggaacattccttggactcatggtttctgttccatacacttcttttcaaattaatacacactaattaacatttctcacaccatatcatgacagatatgtgctaagacagtttaaccttcttgtttatttttgtttatttatattatatatcgttttgttgtaaaccaggagaaatgagaaagagtgtgagctcctttttcacttcagaaaggacttagtataggttttttaaatctcaatttcttccctacctcaccgtcttcaaaatgtccttctctttttcctcatctaatgaaaaggtagcatatctgaattacttactaggcttttgcaagctcagttgaaattataaaagagatgatgttgctttggggaaaaagatgaatctgttcgaaaagaaggtgagacatatgcaggaacacaggtatttgtaacttactcaggattacaaagaagaaattaagaaggacatccaaagttgctcttggcatcacagttagactgagtgctcagacggttcatccaaggcagtaagaaataaagttttttattactatattgatggcagctacatttctagctgcatgcttacacttcaagaaaaatgcctgaatgatgcctctcatttttgttccttgaaacgaatccaagaatgtttccctaatttacctatctgactcaattttccaagatagagactgagtgaaacaggtaatatcggcccataattttaacaagggtcacagaagagtacactggcagcttttcaaaaccagagagaataaatgttagattagtaagtgacacttgtagactattagaatttaatgagtatactatatttagacagatatgacagatgttaatctctgatattaataaaaatgcctaaaagttcattttggagaaagatctgagtatgaacccagactatgacatatcctggttatgtaaactctggcaagtttcttaagtatctagacttgagtctctaagtctgcagaatgggcccaatggtatccacctcccagggttatttaaataagaatgcatacaaagtgttcaataaagttctgggcacataaagattgtattattccaaggcctcgatattcccacacagctgctatgcattgcttgaatagccagtgctgctgaggaatgcagaaatgttgatcaattttctagcaatacaagtctgtcaacataaatttccaaataccaaaaagagcacatattaacttaaatactgagatttataaatctataaataactttttttttttatagggtctcactcttttgcccaggctggagtgcatgggcgcaatcttggctcactgcagcatcgacctcccagactgaatcgctcctcccacctcagcctcaggagtagctgggactacaggcgcatgtcaccatgccaggctaagttttgtgtttttggtagagacagggtttcaccatgttgctcaggctagtctcaaactcctgggctcaagcaatctgcccgccgcagcttcccgaagtgctgggattccatgtgtgagccatcgctctcagcctgataattttcttaaaattgccagtgctactgtaagagacatagttaagtttatattaaaaggaaaaccaaggtattgcttagttgtcataaagttgtgtgaagattaagtgaaatatgttagtggttttctcacagagtatacacacagagagttacactttacacagaaatctatatatcccacaagtaaactgattttaagggaatcattttctagtttcccaatttccatatgtatgatgtcttaaattttgtatgcctgagaaacaatgcaatcaaggcatcccgctggttcttctgtctcaactcctctgtttcaacagtctttcccttactttcgaaaaaaagcatatttttcattgatctcaaatattacaataacatatacatagaatataaaaatttggggataccaaacaaaataattcaaaatattggtgttggttttgagaaaatgattgattctaatgattgagtgacaaaaattcttgcaaatcaggtaaaacccaggtttctgatttcaataaaatagaaagagcaagtcatcaagttgcttaatcacttttggtgaagatcgctaactaattttaggcttacaatggagaaggtgtccaaatatttaggtaaaatgactataataaactccttccagtttatttatttagataaacaaggatttccaatgtctacacctaaaaaaaagaataaaactgatgataaactctatttaagaataatatgtctcgatagatacatgatcaaattatttaaaaagccatatgtttctcattaataaatgaatcttcaataaaattcacttttattttgaataattgtcaatatttatgatatattcatgctgttttgataaagtataaattataaattctaacaatacaggaaatcatttatcatttaaagactgaatctaggaatttttaaaatgtaaaagtccatttatagacatatattttgttaaagagtacttccaaagaggatccttaagatgttcaaattttaaaaaaaacataaaaataggataaaatttgatggagaaattgttttaaaatatgagtttaaggaggaaaaaagaggcaaaacttcccactatttgttagagcatgtttatgaatttttaaatgggtgatgataaatataaaaaagcacagtggtgttatttattcctagtaggtttatttaaaaaatgctgaaacaatttcatttaaagaattcatatttgcaaaacatgggggattatgtcttttgctagcacttgaacttactgctaaaattctcaggtcaactaaaatgagtgaggagtatatggtttataacgttttaattgtagggtatttgtaagcataacaatttgaaaaccacagaaataatgtactgtatataaaaatcttcagtacactttccaatccaacattttttcactgaattgaattgaaacgttggactctccaaaagcatagcaagtaaagttaagctggcctgaccaaattcctttctcttctctattctgataacaactcttatcatcactcctgtataaccctggcagtctccaccttcaagtatcagacaccatgtatgtgtctcaaaggtttactatgccccacacttaaggacctcttggaatttgaggtgttttctaccagccattcacatggtactaaatttttgggaatgcacatcaggacatttgtctgtcagagaaggtttcaagcagcttccaggattgatgaataatatcatgaacagtctataaagatgactttggaagagctcagtgcatagtgtaacagtgctaacagcagggacactgcattgaaatagcatatctccaaatcattgattatctcctcccttccactaataaaaggatagcattgtctggggatggcaagaaagcagtaaattaagagagaagagcagtaagctaccagcactgctgtttcccacactttaagggtttgagaacataactaggtaaatttgcatgtaagcactgtcctagaagagagctgttatttctcaatatgctagtgtctatacaaagttaagaagaaaaacataacatttcacaatcgagaacgtaattttatccttgcctaactcacacctgtttccttttcaaaggactagtgatatccataaattgtcttcaatggcactcataataaattctctttgcataaacaatggtttccactcaacatttaatcttaaaagagtgaatgttattccctactctgagacctcaaagactgtgttccactttttctaagaattctgacttcatttactataatttgtttcagatacttaactgtgggcagagattcttatttatttatcaaatactatacccctctaattttaccattgcttaaagcgtttgacattattttggaaataagatattctaactaaaatgctcgatgatactaatctttcttcatctactgttctcaaagtgtggttcccagatcggtagcaaaagcatcatctggaacttgttagcagtgtacattctgatacataaggccctccaagccttatgtatcagaaactctggagaagaggtccagcaatctgtgtcacaacaagccttccagtttctgatgcatgctaaagtctgagaaccactgatctactggaatctcacctcaccaagaggatgttgatatgcaaaaattggctacagtttacaagttaaataaaaatatttttctttactaacatagatgaatcctgatccataaaagactcataaatataaatcttaaatcccataaattaagaatctgatttcttcttatgtaatcagacatttgcttctagcaggtttcaagatcttcaactacggagaggcaatgacattttgatagtcctctagatttaaggaataaatatgctggctgtatagtcagagtaatgctagagagtttggtctgatgcttagggatttaggacgacgaatggatagagatggtgaggaatctcattccagtcatgctctcctttcctaatttcccttttcactgtttggtcttctcccccttttccttagggagtcgagtgattgatagcctaatccaatgactgtattacagctgcctcaactaggactcttttccttatcattagcagttagcctatggttaaattcacagctcactgcttggtacagcccctgagatttaagggtctggcctttagaaaatatttaacataaaactgaaatcttgacatactgagaactcagttctctgcaaggcttccttaattaatccaatgtactgtaccattgttctgtatgagactgtgacatggtgaactgtttctgaagcttacagagatgtgtagttctaaattaaacagccactgacgtgtacctacactgattttttagtacagtagatatgcatgaatctgtgaatatttaaattcaagctcaaacagtgacacaatactctctagttttactttcataatagaacattttttgattaatttcaagcttgaaatcattctttatgaaaaaacacacacagaggaaagaaatttaataattcattaccactgctgcaaaggtaagttttcttaatatgcttgtcagagttctttggtttacaaagtctatcaaatattttcttaggaactggaacagacattaatttattttcctaatttttaaccaaaggaaaatatatataatatccaggtacccatgaatttgttggctcttaaatactatttggttctaccatttatctgcaggacaatagttatcttaaaatacctaaggaaaggatgtagaccttgatctatgctttaaacctttgcccttgctccagtctgtccatgagctgtaagcatctatgaatatggcagctgagtcccagatgaaaaattatgcatctcataaactgctattctgctgaaatgtcaagccaaggcaaggctgtacctcagactcagcacttggcattttccttctgtctgctttgttgccatgaagcaaacatgaacagtgaagatttgtgtagggcaggtagcaggcgagctcactgtcaaaaatctattattagggccctggtctcctgcacagaccaacgatggctaaacagtgagatactgaggctctgagaaaggcaacataatgaaagaggggattctttgtcaatctgtacatgaatatattcaaatgagcattatttaaatgagaatatttctaatggtaagcctctctcaaccaaagtgataatttataataaaattgtaatctagcatctgtatttgaaatgcctacttttgactgttctgcaaatatagtacatacatatttgtataacaagttctttaatagtttgatcagttaaacttgtaataagctaagaatgtttttacataggtgaataacaggccagattttttgcattacttttgtccatacaaaaaaaggaaaaaagtgagtataaaatggaaggctctccttttaattattctttttgcatgaattactacatttttatccatttaaattctatctttatctatcaggttattttagatcttcaatgttaaagcctaagctcttatcgatcaagatgattacaatagatagcttaaatttgatgacagataataggcatgtttttctaaaagcaatttatgcatcgataatcatgtgattgacacataaaaaaatccagcacattaaaaacaacttcccaattaaaaaaatactaacactgttttttatgatggaattgtaatgtgtggtgtaagaacttaaagcaatcctgccaaaatcttcagttgctggcatgcgtgaaaatagttatttaaagaaaaatgtaactaaaacttctgagtttgtaatctgttttgttttgccatctccctgattttacacaaatattcactaataaatacaacaaaataagtgtatgattagagtgggttacactggatttgtgtttacgtaatgcccagtagcacagtgtatgctgccaagttattattgcattctaacaattcacgcctaagtaactatcttaaaaacacataaactatgcgatgtgaagtcgatgcctaaaatccctttctaagctactatattgattcacatttgtgcaagttttctaaattatacactttgtactcacttctggccctacactgacgcagatctacaaattactagctaaatttctaacttgtaccttcttttattagtatttcctatgttggatttacaatgaaaacacctttaggaagctagtaaccatacaagccagtgtccaatatctcacacagctagatttcaaatcattcattattcacttgtagactctaagaacattcatggaatattccattataacttatttagaaatacacagtcatttactggattctgtaataacctctatgagaggagtaactttgagctgaaacagaaaatcttaaaagccatcttttatgaattattcagaaatcaataataaagtttatgtcttaatactgaaaaaaatgtgttctattgttgtaattgtataagttcatacataatgaataacttcaaacaagcattcaaaatttgaagttaagaacaagaatttcctttcctttggtgaaaatagaacaaatttggcaaataaaataatttaaaataataagtttttcaagcttgtgggaagtaaattatattgagcctaaagtgtctatcattatttcaatttaagtgccttctgcactctttcctatatatgtgaatgtgcatgtgtttgtaagtgcaacacacaaaatatatacaggacaatgaaattcattccccattaataaaaaaaagttaaaaacacaaggaacaacaacgaaaacttcaaatgaattcaccccattgaaaaatgcttgaatactgtttctcccgaagcacctgtaaatgaataaaggttatcctcatgaagtcagctgcaagaaagacatctttagcttatgccatgcaggactgattcttaaccagctctgaaagaatcttacccacagggaggatttcatgtgaaaatgtcacaccacagctggataacaccatttatataggtgatagtaatcactgatttgggggctatcttaagatgccctcattatttgggaatgaagtcagaaaaaaaggtcaaaatttcaaactaaaacaagaaaaaaagaaattaaactgggaaaaataatgggtcacgcagtcaaggatggagtttataattgttactgagattagggtttttttccaatcaaataagtcaaagaatttcttcttcctttcctctctccaaacccaataaactattcagctgtgtgatgatacatgaattaactgctgtttgatgcaacagaagttttctgcatggattctagaaaaaggaaaggtcgtaacaacttagtgttacatctatactgtccaaagaaaggtacagaattatttagaatcaatggtttagacagagtacttatatggtggagagctgaatcagccatccttgtttgataaaaaatattccttttggataccaaacaagatttccttttatactgttctcactatgaaatcatctggtatataattcaactttttaatggagcaatactatgatgtatttctcccataattgaaattcaagtttataaatcactttattatgagtttgtttcatatatttaagcaccgccccccagagtttaatcatctgtagatgaattagaaaaagtgcttctaaaatagcaaagctgaggataagaccttggagtgaggtcctaatttgctctcttgatgtaacttttaagctacagcaggtagaagttatctttctatagtcttattgacttcttttatttaacaaaagagacctccctctgaaacagtaactctcaaaatattttgaagttaactaagtaaaaagtgcgttttacattatggcatatataagtgtatattatgtgtataactgaaaaagaagtttggccaaacaatgcttatcccaactatatgcaaagcattctgacatttcttattctatttcattatttaaaatgttgattacagttcactaaacttgattgcatagtatactcatgagttgggaaccaacctttgaaagacattgctctcaaatccaggctacttatatcggaaataattccactgacattccttagctgagatcccgttttcccaatgcaagtcactgtcccttattagctaatgcattttctctagaagaacattcctgaaatgtgcccagttttctacagcaggtatactactccaggtgcctcactatttccgtatttaaacaaaacataatcttcatttcaaagagcagaaatcttattctgagaaaaataataacaattgaataaacagctaaagaatatattgaaaggggaaaatatccttcactggcaatgaaaagtatgtattgtgttcaggtggctatccaaaattaaactctatttagttttcactttttaaaaatctgtgattcatgcagcatctctgaaagcagacattgccatgctctgagacaacacttgagcagatattagcactgtgctatggtaaattttttaaaaatcttataaaaatatctagcttattttgtgtaactttcagtattaaggcagcatttgaagtcctgacaaccatatttgatacaactctcgtaaaatttgaaaccattattatttaacacaattttgctaggctaagttttgctataactcatactgaaggtactctgttatagaacttgctctgtcctaaaatatattatcattgcctatttaaactgcttttcagattctattacttttaaacttaagcaagcattactttaaaggaggaaaactatattaattctgtcaatgtggagaaaggctattttcaaaacagattgtttaatgtgaagaaacttaatatagaacctattagaaatgaggtacaagtcctttaaaatgttagggattttttgttgtttaaaatgaaagttctacccaggcttacctaagcttatagcccaagtgaatatttatatatgaatttataaatcttagaaatagagttttatggaaatgctaacaggccctgaggtatgactgagcttgttttcaggtactgctataatttccagtgtgtgtatgcttaaagactgcaacacaaaagactttttctaatgctgtaattttgtagttttattagactgagttatagtatgggagaatattcagacattgcagcttaaatgagaaaacatgaatggtgttacttatataaaatactactgcaatagttcttttattaatttttaatgttcagcaccctctgtgacctcctttattctcttgctgtcaacatggcaggctggaaaaattgaaatgggctgacagaaaacatagtgcatgttacagcccaactctggagtctcttgactctctttctgtggcacatgctaacgcggtccacgttattctgcattacaataatatttaaggccctgtttgatagctcctgataaaagcgagctgtgtctggagcctgagcaggtgctcctcgtcagccttcttctttctgacattgtgggaatggcattcaattaaaagcagaatataaccgtttttgttcttcatggctcacaggcatacttcatactctcaaaactgaatacctcagcatggatagagctttatttgtgtctgtccagcctcttccaaaagcacattttggtctgattcagcaatgcttttcttgaacagtggggcactgttatgttatgtatatttaccactttctctatcaccaaggagactaatcccaaaccagtacagtcaagaaccttacagcattgtctttgcaagaccaagttcatgttgtcacagtcacagagtgcacagggtaaagatactgaacaggaccttgagattaaaacctctctttctttttcaaattcaagcgtatgctgatgagaaagagcgtgcaaaggtgtgaggtctgcaaatgtcttgtcagctgatgcttaattcagtgttttaatggcttgtttgggacagttgggacaaggtttttgaagaaggtagatgtctaaattctaggaagaatgaaaactagtccagaccatgaaaaagatattataatgagggtacttatatttttctctcagagggccctcatattaacccttactagtaagtggcaaaagaactgagagacgatgagaaattcttaggaaagcatggaccacaagagaatagaatttgtgcaagaccttatcttgatattctctcatcctgtgctgtcacttgagctttcatattcaatccgttctgtcataactattaggaatattgatcagctatgagttataagaatttgggatcataaagggcacaaaactcttgcaacatgaccttctgatttttcagcaacctccaagaaagcacaatgcaagaagtgggcaacacctaccagacactcctccatatgtagttcgctttgcaatccccactgctggccaaggtgtgccatcagattttaatcccatcagacctgagacagtgttggtggctgtaacgccattggcaccacctatgcaagacacatcaacattttcatgcagctcttataagacacgatagttaaaacccattcaaaccctcacatcccagaaaaatgcattctattttatcttgagaacatgtcttctcctcaaagttcttcactaatttaactcctacatttatgtttaaaattttaaacattaaagaagttttaattaccacaactttactttctcaaatattatacagacttgttgttaccaaatgttttgtatttggtgttattttccaggtaatttacaatgtctttgcaagtcagggtgcaatttccctgggatggaacacaagcacgcatgatttttgtattcaacagatatttattgagcatgtgtttaaggaagtcagctaggccctacaaaatatgaagagaactcataagaaatttcacattgtgcaaattgaattttctttttttcttttttactcattaaagtttaatatattgaattgttacattatgaggtcatttattttggacgggtttgctgtgactgtgttttttgttcttataatgtgtgaaataagtgtttattaggaaaaactataaaggatcttgtgtttccagatcaaaattcatggtcaatttgctagcatgagtccaggtgtaaatctcctgtgtttgtgggatcaagtgctcaactggaaacttttaaaattgagacaaaaaatatgcacatgtttgtaggaaaagacatacttgagtatggctacataatgtgggccaatatttacaatagcgggcaactgattcaagtcaagttcttaccttcctttgcagctcttgcgatgctcacaatatcagtgacatttggggtcagcttggcaaaaaaaggaatctgaacagcttgcctaacccagcggcagatgttccgcaccagctctggatcctgttcaaataggtcggttaaatatagaacaaaattaaagaattgtgatcaaaatgtgtactggaacaacagcaaagctggagacgtgcaagacaaatccaacttgacaatgagctacatgatatatttctcaaattcctcctcagtattacacctagactcattagggaactaaggttaacacacttcaagtgaactgcaaattcatcacataaaggttaaattcctcaacagagcctttagaaaataaaatttcaaagaacaaaatggaagacagtgtttcccactttcagttaaatattatcaggaatgaaacacaaacttttgatgttaagtacaagaaacattacaaaatttctagtgatctcattggtttaagcaaaataaaaaatatttaaaactgctgactcaagtgaatgatattaaatctaaagcttgttttcattattagacttagtcttgatgtgtattcaaaataaaatctatgacttcatcatcaatctacatgtgatatatagtatatgcaaatatggaataattcagccttgtattatacatgagctgatcagtaactttaatttacttttgtaaatgttaccaagatctgtgcagcattttcagcactcacaaacttgacagaattgatcaaaatgacaaaaatgaaataaaatatcaaatgctcattttaaaaagcaagaaatagacatttccatgtgcctattttctgtgattttccaggctcttattttctcatggggcaagtatcatttagagggcaaacacctatcctctccattgaataacttagctacagtacagtaatgttctttgatttcaacacatacaatagtcctttttttcattacttttagtgcaaaatttattctgacaggtactgataatgtgctttgataaattaccttaaagtatgcaatagcaattcattatcgaacttggtaatattatcttagcaagttaaaatgtttttgaataaaagaaaaacccagagaaatacagtcatatatttaaactatgaaatagcaggcaagcatatcatttgtaattaatgtttttgtatgtaagaaagttgctctttgcattttaacctttcgaattcctttaagatgagatttgtaatgttataacctttagaaagaaccttctcacttaggtttaatgtgtcttgatccatcatcctgtattactcaaaaagttatgcatttttgtgctaagatactgcaatgaggtaatttctgttgattgttatcatctctattaagcaaaacttaatacttttaaaaagaagtctttggcttggcttattctctttttagaacagtaatttcttcattaaacataaatattaaaaaagtgctatatggaatgctctacagggcatagtgtgcattatgaatagtaaaatgtggagacttagctgtacaaattctaactcatgaaaatggagatctgcccctgcccatgcaatgctcatgaaatatttataaccactgcattggtattatgaaggcagttgcatctttgtgactttcatttctaagttatgaatttccatgggacttagcctagaaatgacagtaactctagatgatatgaattgcatgtcctttgtggaagctctctttaaggtagactttgacaataatttaaagatcacttgaatggcataatacatggaatgtgtcctgataagaattactgaaacaaatttgaaatattatttggttccaatagagtaaacactaataatctgatataggcttccaagtggctttcaatactattgacccccatgccataataatttactctgaacatctgtcagacatttttcctgattttcactaggtgactgctttaaatgactgcctcttacccattgcttaatgatctggaatttgttcaaagtttttcaaattcttagaaacacatggttttttttggttagcactgtttacttgaatcatctgtctctattttgagataccataatttgaccctccatgagtaaatttgaccctccatgagtaaagttgacggtgttcacatatatttttctcatcttcatacttaggcaagccagctgctgactaatcatcacagccaagggtaagtacagtttggctacctgagaattttaaaaacaacttctaaccaaaattaccataaaaattaatgattgttctgtaaattgcaatgttttgtttgacaggtataatagagaatattctaatacaactagaaatgtggtgaggtcaataacatcatgaaatgaatctatatacttcagggaattcacgaatagactgtaactatttatattttcctggtttcttcaaaattttgatatgaatgttcaagatctaaaagcaattagtagtgtttctacatcttgaccttctcattttctagtgatagcatgagatggctttgccttttgtaacaagccagtttttagaatcttattgaaataaataagttttagacaatttctaattcttcccaaaatcttcaggatctgaaatatacaaaagtactcttatctctcagacaaatcaagagtttaccattaccaatacatacaaggagaagaagaagaggaagaaggaaaacaaaaaacaattattgactgctctatttctgggcactaaaaaatatatgttgtgtcaatgaatgagaaatgagtgaaaacttggcaacttggcatattttcacattatttccttatatatccatcaaaatataaactatgtctagatttaagaaaaacccagctatattttatgacaatgtccaaaagcatgaaatgtaggaagactactttacaaatcactggtaattctgtgaaaaagtgatggataattaagaaaaacagaatagcttaacaaaatcttaaaaatgtctaatacacaaaaacgtctacgtagatcacaaaggctttattggtgctttctaaaggcattaatgcttctccctgaacatgatttgcaatctctgtcacagtagttgcttgtcttgtgtgtgtgtgtgtgtgtgtgtgtgtgtgtgtgagcatgttcttcaatacctgttaacccttttgctattcaatgtgatcaccaaagaaagctctgaagcaacaaaatgatttcctgtgacagaggtgcatggcattataagcagaaagacacttgaagcccctaagagaatgagtgacagatctagggagcaaatggtggtcttgaggatactacataaagtgaaggtaccagagcagacttgtgaagtgctgagaagagttttgataaaagcaagctagaggcaaatttggcctatttgaaaattttgatgaggtacagcccagtgtctgcctgcaactaatcttatcgggaatagattcctatgaaaatcaaacaacggtgacaacacaactagaaaaggtaatgctgaggaatgcagattacttgctgcagtaatgtccattatgcaaaactggttgtttttaaagcttaatttctaatctgggacacaagataataatttttaattctagtaactactctgtatttagttacacattaagggagttctataaatgacccatcctgctgcttttgagaccctgaagatgacctcttcattgtagagcaggtatttctaccaattacttagggcatcaaatctcactggtttcatgtcctctgcaaaggaataagcactacagaatgagactgagaatttcctgataagctaaattacaagtgaaattttgacttgaagaaacatttctctcccatttacctagtaattttcactctgtacaattcatttcaaaatggctttcttagaatctggcatttcaataaatccactgcaaaattttaccagttataaaatgtttttcactaagcaactcttaagtcttaattcatatgacatgccaagaggtggctagaattttcattacatccatgtttctgatggaaagaactggggcccagaagatcaatctgagtaccaatttcaccttcttaattttctttcccattatcatgtcctaaaccttcatcttctttagcaaaattgctccctgaagtgaaattcagccatcaattgtaaactagaactatcgaaggcttctacttcacttattcctgtaagactagaagtagctgcaacataatgagcaaacgtgatgtattatccttctatgtcaataaaacaggacaggcagtcaactgttccaggcacaattataatattagtgaatgcaaagactatgtgttgaaatggagatgtttttattaactattttttagcatgtgtccttcttgcatctgtttttctgacttaagtattctaaaggtggtccaaccactttggaaattagttgtgcagtttcctaaaaaggtagacatggacttactaattaacccagaaattcaactcttaattatatatacaagtgagatggaaacatatttctacattaaaacttgcacatgaatactcacagaaactttttcaaaataggcccaaatttgacataatgccaatattcatcaatatgtgagttgaataaacaaaattgctgcatatccacgcaatgaaatatgattcaacaacaaaaagaaactaatgaatcatgccacaacttggaattaataaaacaaaatgatgctaagttacagaagtagacattatatgcatacatttattaaaattctgtaagaggaaaaaccatgagtatggaaagcagagcagtggttgctgagactgagaattaggctggaggagcaattaagtggaaataagtataagaaaatttttgagggtaatggaaatgttccattttctttaaaggaaaactattgatatatttgaagatattaaaattaaaatgttaatatatttaaaaacattgtgaaaagacaaggcacaaagtgggacaagattctgaagcacaattcataaaggagtagtatccagaatatataaaggaccacctgaaaattaatgagaaaaatgggcaaaactttaacatacttcgttcaacatagcatacttcattggatttcattcaagatgaaatccaaatggccaaaaaatttatgaaatgtgatcagccttatgaacacctttcacattttttccatataaggacaatgctcatttaaaccacaatgtgatgccattatctatctaccagattggggggttgggggaaagtcaatacaccctggggagaatgtaaatcagtacaagagtctttgggaaacagtttcacatgatctaggttccactcttacgtatatgtccttttaaagatgcaaactccagaatacatgttcaaaatatccatagtagcactgtttgaaatagccccaaagtggaaaaaatccaaattgtccatcaagagtaaaatgaaaaataaatggtaatatagtcatacaatggaataaacacactagagctatatacaatgataaggattaatctcataaggcttagcaaaagaaaccagtctcaaaagtatacaatataatttgattcatataaattccttaaatagaaagtaaatatggtctttagagacatatatatgggtgataaaactacgaagaaaagcaaagcaaagagtagggatggtgttaaagtggacagagagggttgtgttagggtgggacatatagggagcttttgaggtgttggagatgttctatttcttgacctggtggtcacatggtgtgcacattatgagttgttaaaaaatatatatgtgtgtgtgtaggtatctgtttataaatgcatacatatatgtttcatgtatgttgtctatattccacaataagaaaatatacaaatgaccagcaaatatgaaaagacatcgaatctcgctagtaattagaaaaacaaaagaataaacatgatcacctatcatgatttgccgaaaatgtaaagactgataatatccctctttgctgaggttgcaaagaaacaggcattctcataggctctcaataggaaagtaaattaataactcctttttaagaacaatgtggtaatatgtataaaaatgtaaagctcatcttataagttttaaattccaattccaaatacctagcctaattaaatccacatgcattcaaaatatgtgtacaaagatgtctgccattcactacagcattgtttgcagtagtggaaaaaaagaataaatgtcaatatgggaagatttgtgaaaagtactataatccatacaatgaaatactatgcagccattaaaaataaatctttgtaaactgacatggaaagatatccaaaacatattaagtgaacaaaagcaagacacagaataacacacagatagcctaatcctgtttttaaaatataaatatgtacatatatttatatagaggtctgaaaaacagactatgcatttatgctgtaacctgttagcagtgattacctctgaaacgttccatattttgaatgtggtataatcgggtatagacatttgccaaaacacatcaaactctatacttaagtgtgttcatgctaatataggtaaattatttctaatatagataaatttcatctattattctaaaaataattctaaaggcactcaaatataaatagaaaaatgaaagaaagtggcattgtaggtaatgtgggttctacccttttggcaaatatttattgaccatgaggcactacaaattttccgtgctgaacactaagatgaatgaaactagagtctgcaaggaaatgcaaaccaggcacacaataaaatggacatctgatattaagtgtcacaaaagacaagacatcctgaaagtgttctatcatttcagcttatttcagagcatgtagcgcagaacctgacacatagtaggcattcaacagtattgttgaattgatagagcctacaccacacaaattgacactgactttcttatttctatgtacttggaggaaaattgagagtacagtatactgggtccaggataacataatagataactgttttaggtactatattggataatacagatttagagatatgtaatatgctatccctgttctttaaaaacataaagcaaaatactttacaatctaggggagacaaatgcatacaacaaacacataatgtgattataaaatgttgtaactgtatatacctggaatgtgtacatgtgtgcctgtgtgtgtgtgtgtgtgtgtgtgtggctacttccttgtgccttaaatagaagatgacatagacccacctgtgtgtcctctcctccccaagcacatagccttctctattctgtttctcatttcaagttttttcttatttttctctttctacctggaatgcccttcattttttgtcccttgaataacacccttcaacgcagccctccatgacaaatccttccatctcacttcagcataggatggattagtaaatgactgcctctttagtgctcctataatgtttctttattactgcatttatcacagtgttttatagtcatcttctctgttccataatcaatttctttctactagactattagtcttttaggggatgtattttactcttttatcctagcaaagagcctggtacatgaaagacaataaataccatgttgaatgaaagaatgaagaatttctaattgcataccagctttccatcatgaaccacaaaacatttgcatctcctcttccatggagccaaaataagctggagatacaggatattagcagctcttgctccaggagccaactgagtttgaaaacagtcttttgatgctctccatcagtgagctaaaatacttggagagaactgtctcctactgtggcctagaagtccacgagaacccacctgaggacccaggctgaccatgatcctttctgtctgaacctttaatatattgagggcttttccagagtttgtacctctgaccctgaccctgcctcaactctcagtctttagtccctgggaccttgaggggaagggagatgctgtccatatttttatcagctaaggggaactatattcctgttttgttcctttaaatatcatttctggtgaacataacttaatgatgtttttttcttcctttcagacaaaatttccctagtgtaccattcctctgacattcttagtgtcaatgctccccattccacttagtcgctaaagctttctttttttttttttttttttttacaaatggacaagaattgccatacactactcactgtttagttaattcctgactgccagcgttctttcaggcactattttaattctctgtgaggactctcagatcctctccaccagctcacttctttactctcaaatggcagtgttaattgtagagatcagccctgaaagctgttcaaatttcagatctcctctgccacaatttgtccctatggaatcagattcagatttcatagaattatcttgcttctgccggctaatcccaacaggaaatccacggcctcacctggccatggtaatgaagtttgagaggtacctgcccaaataaacagatcaatgaacaccttctgcccacagtttcatgtgctattctagacactgagcctctcaggggcactgtagcactgttgctattttaatatgtaaataccttgtctctattccaggaatcccatgttgcatcaaagaaatggaagcagggctcagaccctgcatggtagagggggctctgcaatttaaagggttaactttctgcaatgttgaggagtcgcataacttttcacgagaactgatgagtagatatgctaaagtaactaagttctgaaaacgtctaagaaaaatacatgcagaagcaggcaactgcaacagacacagacatgaaccactcggatctaccttcaggaacagactctggcccagctgcaggagtgtggtgagctgactgcctctaactgcttcctcctttaggtgtgcctcgcttttaaactggggtcatgctcctttcagggagaccccagtgaatgatagcaaaactgtagtacaagggtctagctatttccggtgaatgtgggactcctctaataggcactttttgtcctgaagctccctactgggctagcaaagacttttcttgtgtctgtatcagggtccaatggctccccttttccaattttgcttccacttttttcctttcacaagcatttctctccaataaacctttggccctcctaactccctctctgtgtctgattcctggaggactcaactgacacaacagttctctacttgtatgaagaattctccctgtaagaggattacgctatattctaggaaagtcaaagaagaaagaaacttgcccaagtgaccccaggatatcttactgagaggaattcaagaaagctacgctgaatccaaacgaatctctcaaatttcttctgaattctagttctacccttggcttgacagaacaaggtctcttggaatgtcctgaatacagttaagccttgttggtgacctacccagcaatagccaatatatgctcaggggaaagaaaaggtccaataccaggaagcagggctaatttttttcctagaaaaagactgcttttagggacatggtaggagacaatgattgagtgacctctgcaaaaagacaactcagagacatccttaaagagtttggacacttacttgatcttttgattcagaacttgctcaaactcactattgtgatgtgggactctggaagcaattgtgcaaatgcccatggataaaggacatgatgcctttgtgtccgcaagacaaaattatccatcaagggaggatggccagaggaatcagtgtagatgctaatactcattccaattctttgtctcttacagatgcaatcaatgacaaaccctttaaaacatcactgagaggctgggcacattggctcatgcctgtaatcccagcactttggaagactgaggagggtggatcacttgaggtcaggcgttcaagaccaccctggcccacatggcaaatccttgtctctagtaaaagtaaaaaaaagaaaaaaaaaaacaaaaaaacaaaaaaccaggcatggtaacacatacctgtaatcccagctactcaggaggctgaggaatgagaatcctttaaacccaggaggtggaggctgcagtgagccgagattgcgtcactgcattccagcctgggagacagagcaagactctgtctcaataaaataaaataaaataaaataaaataaaataaaataaaataaaatatcattcattgagaggtcagatgaaacttcttccaggtgtgttgggcctccaatgccctctgttctgaactgtactccattctaatgtctgccttagctttcataatccattctgcttgtttgaagtctagttctccctttccgctatctgtactctacatttctagactttatccattgttcacttctttctggattggatccctctgagcctctatgcctgcctgaattgacctaaagttgcctaccttgcacccaaaattgatccatgacttgtctgtcacttaggggcagccattcctttctgccttataatgtttttctttacctatggtgtatattcccaggtctatttcccttgtctttaattttatcatgttttttttgtaaaaccaagattgacacaggttccataggcctatcttcacaggcaaacaaaaaactcttcgagagccatacattggccatatttcgcagtaattaggacacctccaaatcttctacattaaagcatttcagaatagtttattcttttgttgaatcctttatactgggccaaaaaatgagcttgaactttctttatgtgtgggatattatttatctttaaattaaaatgctagttttatctaccatacaaaaagggtgtcatccatagtttgcttattaatgagggtatgcagcataatttggaagatcttaatatatgcagaaacaggtcatgtacacattttcctgataccaccagtaggtgttcaaaattgtggaccagctgagccaaaatgaaccccagcaggtttcctaatcattgcttagaacacattaaaaagacctcagtgggttatgaaatataggcagctgcttgccctactatgtatggattcattttggataagggcaagtgtgtatgtaaatgtataataaggagtttttattctttgcagacttcaagcagcttggcatttgttttcttaatgcaaagcattagtgtaaacagtataacaatttatattttatacatctgctggtctattcacttagcttatgtatttcagtgctagacttagaaaacaaccacaagcataaaacctcagtatttttataattccatattgaagtgaatgattaaccaacacagggaggaagctagtgtggggcaccattctgccctggagcacccaccatgctgatacatttaggatgaagagagtctagggaagtcacgcttctgtcctgggaatgttatgaaatccaagcaagaaagaattactattgaggcaattttaaataacctatcagagaaaaactgcaatcccttggcaatgaatggttccgactaaggagaactcatccataacaagttggtatagttctttaaagaatttcaattttcaacccagaatttcatatccagccaaactaagcttcataagtgaaggagaaataaaatactttatagacaagcaaatgctgagagattttgtcaccaccaggcctgccctaaaagagctcctgaaggaagcgctaaacatggaaaggaacaactggtaccagccgctgcaaaatcatgccaaaatgtaaagaccattgagactaggaagaaactgcatcaactaacgagcaaaatcaccagctaacatcataatgacaggatcaaattcacacataacaatattaactttaaatataaatggactaaattctgcaattaaaagacacagactggcaagttggataaagagtcaagacccattagtgtgctgtattcaggaaacccatctcacatgcagagacacacataggctcaaaataaaaggatggaggaagatctaccaagcaaatggaaaagaaaaaaaggcaggggttgcaatcctagtctctgataaaacagattgtaaaccaacaaagatcaaaagggacaaagaaggccattacataatggtaaagggatcaattcaacaagaggagctaactatcctaaatatttatgcaaccaatacaggagcacccagattcataaagcaagtcctgagtgacctacaaagagacttagactcccacacattaataatgagacactttaacaccccactgtcaacattagacagatcaacgagacagaaagtcaacaaggatacccaggaattgaactcagctctgcaccaagcggacctaatagacatctacagaactctccaccccaaatcaacagaatatacatttttttcagcaccacaccacacctattccaaaattgaccacatagttggaagtaaagcactcctcagcaaatgtaaaagaacagaaattataacaaactatctctcagacaacagtgcaatcaaactagaactcaggattaagaatctcactcaaagccgctcaactacatggaaactgaacaacctgctcctgaatgactactgggtacataacgaaatgaaggcagaaataaagatgttctttgaaaccaacgagaacaaagacacaacataccagaatctctgggatgcattcaaagcagtgtgtagagggaaatttatagcactaaatgcccacaagagaaagcaggaaagatccaaaattgacaacctaacatcacaattaaaagaactagaaaagcaagagcaaacacattcaaaagctagcagaaggcaagaaataactaaaatcagagcacaactgaaggaaatagagacacaaaaaacccttcaaaaaatcaatgaatccaggagctggttttctgaaaggatcaacaaaattgatagactgctagcaagactaataaagaaaaaaagagagaagaatcaaatagacacaataaaaaatgataaaggggatatcaccaccgatcccacagaaatacaaactaccatcagagaatactacaaacacctctacgcaaataaactagaaaatctagaagaaatggatacattcctcgacacatacactctcccaagactaaaccaggaagcagttgaatctctgaatagaccaataacaggctctgaaattgtggcaataatcaatagtttaccaaccaaaaagagtccaggaccacatggattcacagccgaattctaccagaggtacaaggaggaactggtaccattccttctgaaactattccaatcaatagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaatacagcatataaacagagccaaagacaaaaaccacatgattatctcaatagatgcagaaaaggcctttgacaaaattcaacaatgcttcatgctaaaaactctcaataaattaggtattgatgggatgtatttcaaaataataagagctatctatgacaaacccacagccaatatcatactgaatgggcaaaaactggaagcattccctttgaaaactggcacaagacagggatgccctctctcaccgctcctattcaacatagtgttggaagttctggccagggcaatcaggcaggagaaagaaataaagggtattcaactaggaaaagaggaagtcaaattgtccctgtttgcagacgacatgattgtttatctagaaaaccccatcgtctcagcccaaaatctccttaagctgataagcaacttcagcaaagtctcaggatacaaaatcaatgtacaaaaatcacaagcattcttatacaccaacaacagacaaacagagagccaagtcatgagtgaactcccattcacaattgcttcaaagagaataaaatacctaggaatccaacttacaagggatgtgaaggacctcttcaaggagaactacaaaccactgctcaaggaaataaaagaggacacaaacaaatggaagaacattccatgctcatgggtaggaagagtcaatatcgtgaaaatggccatactgcccaaggtaatttacagattcaatgccatccccatcaagctaccaatgactttcttcacagaattggaaaaaactactttaaagttcatatggaaccaaaaaagagcccacatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccgcatatctacaactatctgatctttgacaaacctgagaaaaacaagcaatggggaaaggattccctatttaataaatggtgctgggaaaactgactagccatatgtagaaagctgaaactggatcccttccttacaccttatacaaaaatcaattcaagatggattacagatttaaacgttagacctaaaaccataaaaaccctagaagaaaacctaggcattaccattcaggacataggcgtgggcaaggacttcatgtccaaaacaccaaaagcaatggcaacaaaagccaaaattgacaaatgggatctaattaaactaaagagcttctgcacagcaaaagaaactaccatcagagtgaacaggcaacctacaacatgggagaaaattttcgcaacctactcatctgacaaagggctaatatccagaatctacaatgaactcaaacaaatttacaagaaaaaaaaaacagccccatcaaaaagtgggcgaaggacatgaacagacacttctcaaaagaagacatttatgcagccaaaaaacacatgaaaaaatgctcatcatcactggccatcagagaaatgcaaatcaaaaccacaatgagataccatctcacaccagttagaatggcgatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaatgactataaatcatgctgctataaagacacatgcacacgtatgtttattgtggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaccatcattctcagtaaactatcgcaagaacaaaaaaacaaacaccgcatgttctcactcataggtgggaattgaacaatgagatcacatggacacaggaaggggaatatcacactctggggactgtggtggggtggggggaggggggagggatagcattgggagatatacctaatgctagatgacgcgttagtgggtgcagtgcaccagcatggcacatgtatacatatgtaactaacctgcacaatgtgcacatgtaccctaaaacttaaagtataataaaaaaaaataataaataaataaataaaaggaattaggaagggaaaaaaaaatttcttcccactgctgctgtaggagctggaaagaaatatctaggccattttgtttgtttgtttgtttgcttgcttgtttttgccagctctgtggactgatatccctttttgaggtaaatactcaaaactaaatactaaaggaaataataatactaaggaaatactaaagtgggtgactttggtagaagtctttggtgataatgtgggatagagaaggctttaaacatgaccttttgtaagtgtagtattcacaaattcaaaatgaaattcatggatactggattttatctaaaatctttagcaatcttgaacctaaaaatccttgaatatatttattacactcatgtggtggtttataagcatacatgtcataaggggtgtgtctgtgtaaaaagagagttctctattttaatctttcaggtgtcaaggaaaggaaacatggcgaggttaccccattttggggagtttattacaactatacatggaaaaataaaaaagtaagtgaaatgtttttggtaaaggaagggctaggcctctggggattgggacaccataaatcattttgtaagacatacagcagctctaaagagcagctcctgttttcttgttgttactttaggaatgggtgtctattgttttaaggattaaaaactctgcaatacgaatacatctgctcttatttctcagcatctcttattccatttctacttctactcactttctcctttttcctatattagctttttggttctccaattcaatttttttcaaaattgagttgaacttggttttccgattcaatttttttactattttttatatatatatgcatatatatgtgtgtgtgtttatgtataggcatatatatgtgtaaatatatatgtatatatacatatcatatatacacgtatatatatccacatatgtgtatacatacatatgtatatatgtatacacatttatatacttatatacatatgtgtatatgtacacgtatatatacatatgtgtatatgtacacgtatatatacatatgtgtatatgtacacgtatatatacatgtgtatatgtacacgtatgtatacatgtgtatatgtacacgtatgtatacatatgtgtatatgtacacgtatatatacatatgtgtatatgtacacgtatatacatatcatatatacatatatgtgtatatatacacgtatatatacatatcatatgtacatatgtgtatatatacacatatatatacatatcatatatatacatatatgtgtatatatacacgtatatatacatatcatatatacatatatgtgtatatatacacgtatatatacatatcatatatacatatatgtgtatatatacacgtatatatacatatcatatatatacatatatgtgtatatatacacgtatatatatacacacacacatatatatacatatatatataatatatttaaaaacaaatccacagagaacaacactcagtacaaatagcgttctttatattttggctgtctgaaatttgacttcccttcctatttgcaggaaatttaaatcatatgaagcattggtaggacacaggaactatccccatttcgcaagtctttgaaaagagggtcttactctttctactgtcttgcaaccaaaaaaccagtacatgatctaggcctaggcaactgaagatccagcccaaagttttaacctcacaatcagaaaagtggttaaattgtatttgtggtagtgtgttgtgcagcatctcctgacagtatcccatgatggcagtagtggtggatatcaaccctggtagaggctgtattagctggacaactcttggtgttcattctctgagccttttcgttttttgcccattttctaagcctgctgttcctgccttctttgattccataagccatcttgtatcctgccaataaatctcctttcacttctgacagccagtcagtttctgttgcttgcaattaagagtgttaattgatacaggcagttggccactatccagtgtggagtgacattattgcctgggttatggcatcacacttcctgacaagttgctgacctctttttatttagtctccaagtggttgctttttgctcagggatacaatatctggtccaataaattgtggtcaaggtagccaggacacacacttttacggcaggtgtatgccaaatactgcttctgtttacttttctttagaaaggagctattggcctggccgagcaggtccttagtttcatggactatgtggaaattacaagagtaaggcatcaactttgtcctcaaagaacttacaatcaagttatagtttcagttgtgacacttaaactatgtcaggttcagcagaatataaaaatggcctttagaattacaatacatctctattcctctataaatcatttagcattttaatatgtcataatgagtaagccctcatataattcaggagacccttgcagaaagaagtgataaatatcacccagatccaggaaagctttatttgaaatgtattaacagtggctatgatttctacaagatggatatgtagacagagaacagtaatatagtccataagggaaaatatcttgaggcactgaagttaaattaaaatatgatctccctttcattctcaatacctgcatgattaccaattcgacaaggatctttcatttatcccaactcaactttacagaagtgcctgaagcctacattgttgataaaacagttgatgaagttttcatgggggaaaaaaatctttaaagtgcttgatatacaaaatcatattagtactaaaacagatgggtatttacttttgcaatattcaacaaatgcagagtacccaaaggactgctaaatttagatagtttaaaactttgcgctttttttcacttaacaaggaacatactatggtgaactttgctggttatgtaattaacacctagaagcagcagcacctaattagatttttacatcatctgggcaaaggcagcatccagcactataaagaagtctttatttcatacctttcaaattgctactattcctagaacttaacataaaactgctaaaatcacaaatgcaactcacagatttcttactgctttttcctttttttgaaagtgaataatttgtgggaatactgaaaccttctgaatctggaccaatgtccttaaatgagcacttgcaactatcctgcctctaaccatgaaagctttacagtcttcatggtttaggccattctgggtttggtaaaataaacagacataaaaatgatccaaaacaatctgctctacttgaagtgtttatgaagtgaatgaaaacttagcagtggagtgattactttttattaacttctagagtgtgtgtgtatgagagagatgtgaggagacaacagtgaaggtgattgtagtttggaatcttgagggattcacaaaatcactggctggagtagagcctatggaaaaatgtatgactaaaaaatacttaagaaaaggttcaaaagcataggaatgcatggtatcatatgaaatgggaaggaaactagtgcatatgaaggaagcagggaggagacatgtccacatggttcagctagagtttagggtcaatttttgaaagattttgtgccttatcctttaggcaataagaaaacatggaaggccatatgtttaatccatgttttagaaacataactcttatatatgtctatggggtgagagtataagagtccaagcaggagaccaatcagaaagagaaggtatggctaatgtgaaacaatgtcagtgaaaatcaataatttcaagtggactaggatgttattttaaagatgaatgttaaaaagtttcaagataaggacaaatcagagttggggaatgaaaatttaaaattttgcagatttcaattgctggaggatagtaatgtattcaatcaagttaggaaacacaagagaagcaggttttggcaagggctggggaagggtgaatgaatttcagatacattgagtttgaggtctctatgggacatctacctgaaagaatctggttgagagttaatagaaatctggatctcagaaaggagttttggaaacatagatttgagagtcattggcataactctcaaattaaactctaattagtagatggtggttgatgtcttgtgaatggatgagaagatggaaggaaaagggcttaagctttgggatcattaatactaaggtgcagaatccttataatggtcagagagagaggagaacaaccaggaaaaatataaatgagaagaccacttcccctaaaaaagatgtggatgaaattattgaggtaaaatactgcagagaaattaggtagaatgaagactgaaatgtaagtaatagaatataccactcacagttattggcaacttatgggaatgtagttatagacacctaataagatggaaggcagattgcaaggggttaagaaattaatatttgcaaacatatagtcaaagaaaactaacaataaattaatctgaactatcagagtctataactgtgttttacataaaatacgtataaaacaaatatagcaattaattatcattttacagttctcacaattagaactaatgacatgatgaaagagatcatctgttatgttacaaggcaataagtgtatgtaaagataaagagattataagacattttaaaataaatcaattgtggtttaaacaacatcctgaattcttacaatgtgaaaccagcaactgtctgagacaccaaaaatgaactttgcttattaaacacataattgagatcacaggcctaaataggacctgaagaagttcccagacaatattaaaactaacatatataccacagttaatgattttccaagtcctctcacctattagctttacggtgcttaaatcattccagctttcttattttctttcaaattatccctagcaacagatacagtagactctgcttctcataatatttataatcatcaaattccaatgaatatctttcttatcctgctacagattaaaatcatatctacttgtcttaccttgaatgagaaaagaaacaactatttaccataattcattcaatattcctacattatatttttcaaatgttattttcctgattataaaaaaagttcttaattattgtggaagcaaataccaacttgaataaagaagaaaaaactaaaattactcataatgaaacaactaaatagaaataaaattaaaaaggtctatttcctttgagtaagaaaattttactcctttattgagtaaatacactgtactcaaaatttaatgcttatcatttttagttatatatccttcatttttatataaggtgcattccctatgtcactaagcttctttaaaaatactattttaacagtcatatatttcatataataatttataaatcatatagatacaccctattttacttaattatttatttctcaatttttggatgttgagattatttccaggttttgttataaataacatggcactaaatctcttctaataggtggtgctcatacattgccttgcttttgatgctacgtgctgtgttcataggcaaaactgatattacaaaaagcaaatacataacaataggcatttagaagatataacttcttagaagaactgggtaatccatagctctgggcctggcacaagcaggaactttgatgctgtatgttaacacaagggcaactgatgaaggagatataagtgggtatttcagttgatgcacgatacccatccacaattggtcttcaaatctcctctgtcctctgagagagagtagagtatacagggcttctatgtcttgctcacatacagatctcctctcagatagcacatgcataattcgatttgtccacaatgtataatctgagcctatgttattcataatagaattgcctaaaccttatacaccatagagatgcctcttaagaaataaaacagtaatgctactatattatagacatggttatttctaaataattaagaaagagacaatagcctatataatacatataaatcatggcatgcagcgaaaaccagtcactatatagtatgttaggaaagtcatattagtctacttatgtttaactcccaggccagagtttattaatgttgtttcctccatccacaatatccatcccattcatatcacacacacttgctcctgcccttgagtgaatttactcatttacttttccttcagattttactcagatttttgcttaatagaaatgtacttaacagatgaataaatgaatactacttgttatataactggatactatgataaaattatttgaaaagtatcaatagtgttataggtatccaaaagacacattagttagaaaagataacagaactatatcctactagaaaagggaaaaatggtcagattacataaaatataggtttacttttacaaagtatacttaagtagtattttgttaatcatttcagagttatagatttacttttatacaaataaatgtacttaaagtatgctgaaattttactgtgattatgttgcaatcaattattacagaaaagttgtgaatattcaagttggacttatttgtatcagctctttacaccaaagggctttttattgtatgcttttgttttatttcacatttaattaaagctaataatttgtttaaagtttgattagagaaaatattttccaaggtgagtgagaaacaacttctgaatattacttcctagatttttggacaatttggtaggatgaacttaagcctaaagcacctattaaacaagaaggaaaagaagaataatagtaaatctgaattttgttaagatttcatgaatagaaatgagcattacaaaaagatatttcaggatgtggaaatgctaccaatttgaatactgcataaattcatttttgtggtgatgtcactaactttgaattatccgtattagagtgggaacagccatttatattacaagcatattcaaaataaagtatatgtctctttgggatgtaatcagcattacaaatgtacactgctaacattctttattttcagtatttaatcctgtattaaagtgatgtttgatgagcactctgtggctactaatgggtaagggtaagaaataattttgaggctgggcgcagtggtttacgcctgtaatctcagcaatttgggaggcccaggtgggcggatcacctgaggtcaggagttcgagaccagcctggccaacatggcaaaacccggtatctactaaaaattaaaaaaacaaaattagctgggcatggtggtgtgtgcctttaattctaggcactcgggaagctgatgcaagagaatctcttgaacccaggaggtggaggttacagtgagccgagactgtgccactgcactccagcctgggcgacagagtgaaactccatcttaaaaaaaaaaaaaaggaaagaaataattttgagaccccatgcatgaatggcacactagataaatgtcttaccctatgtttgaacacagattcacaaaagaatgactatcaggtcatttttaccatgtttgtgacttttgatgaaggttaaaatttacaaagaatggaaatattttgatatcttatttctatgttatttctggtcacttctagaacaccaaaatatgcaatgtatttccatctcaaaaaaaattcaagtcctaacttgactacaactttcgttattatgtatatatgtatataatcctaatatacaagaaacattttacttatatttcttaattcctaattagatagtgaacaactgtttggacattaaatttcctgtattttgccctgacacaatataaagtgaatcaataaaaataaatactgattttcctggctttaaaagaaatcaggatgagctcaaaagcagccctaaaaaattgaaaattgaaaagatgataagttcattctcttttatatcactccttgttgtggttcattgttataactgttgtttaattaatatccaaacttgcataataactaaagtatgtgaatggtaaacagtagggtatcatcagccataattatcttatttgcctagtagtgggctgcatgttatataaccagtctgtaataatccttatttgatgatactcattaattcattcactccacaaatatgtattcaactgctactctatctgccagagctcgacagtaataagacaaagctacttttctcatgaagttttcattctagtggaaaatatgataagaacaaaataaataagtaatataatttcaagtaggtgatttaaaaatatacaacagggcaagggatgagggggtagagagtggctgtaagggtgtggtacactggggatgaattaccttggataaccttttgggaaagtcacagttaactccgtatattctataactacacaaattatccatttgcttttatagttgcctttaaattattttaatttcatgaacttaaattttgtctttgctcacagattttgagttgctcaaagttagagatcatgtattttttcatcatgcaatatcatccacagggacaatcataatattggtacatgaaagacacagtagatatctttgttgactgaatattaattcttgactaaatattcattacttagataaaactttttaaaaataaaacgcaactgcaaagcaaatgtaatgctgacatatttcatatgatcattgcctgtctacatgatccagttctatataacacagtaagaggaaactgagatacaggtgtgagaaagcttctaagagttaggataactcttagccaagtcactagctcacaccagcctcatgactcaaattttttgcaaacctatatattgaggatgggtgtggtggctcatgcctgtaattccagtgttttaggaggtcaagacaggaggatcgcttgaggccaggagttcagagccagcctacgtaacaaagacctcttctctacagaaaaagaggaaattaaaaagttagtcaggcgtggtggtgtgtgactgtagtcctagctacttgggaggatgcggcaggaggctcgcttgagcccaggagagttcgaggttacagtaagctatggctgtgcgactgtactacatcctggatgacagagcaagaccctgtctcaaacaaacaacccccctgccaaaattgtgtattggtatattttatacgagtccattcaccaatagttgaaactgcaaatgtttgcactcatgttcatatgggttatgggtaggtaatgagattttcttcacaaaggagaaaagcaaagaaggaggaaagaaagactaaagaagactagagctaataaattaaattattaataactcctctgaagtattataacatttagcttttgctacaaattatatgatgatgccatttgtgtagggcagcttaagaataaagaatagtgtttttgttgttgttcagacatggatacaggataatataaagaatgcttgtgattttattaagaaaataactttaaaattccacttggaagctatatatgttcaggtcaggatgaaaaattctgagaaatacagatctaatgggagtattaacgggatattctcatcactgttttatctattatccagaaacttttaccttagaagaaagaatgctttatttctctcgtattcaaggtttacatatccaggtcctatgaattccatctgagatgctattagttgatcattgttatcttctaattgtgtgcctaggaacactgagaattccgttggtatttctgagcctagatctactgtccagagtcatacacccttcttgtccagctctgcaagtggtaatctgaagtctgagctgcttctctacaatgaggcacacatcctgtctattcctgtagtctctgagctagttctgcttctgttttacaatttaactactttaaatgggccagattgtttttggaaaatttaaaagagctaaataaaaatgtacatgtataaaacagagttatttcaagtttctcacacatgcattcaatttttattaaacacacacgcatatatgtatttttagcaatataataaggatggtagtaatattaaagtagaactaggaatagcattactataggcaaattattgaactaggaattctgagtttgaaggcttgatgatttcgttgagttttgtgtcctagaagcatcttcatctgctccaagccaagtactctgtcttcatgcttgggcatgaatacaattcaagatagttaccaacaaaacgatagtggtgccttgtcatgtaatagaaaagatattgcacttttttgattcctgacatagtatgaatagtaatgtaaatcacaaactctggaaaaatgaacaaaatgcatagtcaagtaagtaaattctttattattgttgatggatacattgaaaaacacaaaagaggctgaaattaaataatctaaatctctgagagtcatagactaaacatttgctgtttcaactatttgtgaatggttgtaaagaacatattaatatgtaattctgtaagaaacttgaatcatgcagtgagggtatgtgaatgactcacatggctaagaatgagttgaactttcaagagcttttccagctagcccctacactgtagtctcaactctttttttaacttagtagtttaattttgtgaagttttatttaaaagacccccaaagaaagccaactgctaattcttttttttttttttttcagacagagtcttgctctgccaccaggctggagtgcagtgccatgatctgctcactgcaacctccgcctccctggttttcaagcgattaccctgtctcaggctcccaagtagctgggactataggcatgcaccaccatgcctggctaattttttgtattttaatatttggtatttctgggcctagatctactgtccagagtaatacacccttcttgcccagctctgcaagtggtggtctgtagtcagagctgcttctttataatgatgcacattcggtctattcctgtagtctctgagctagttctagagatggagtttcaccatgttggccaggatggtcttgatctcctgaccttgtgatccgcccttctcggcctcccaaagtgctgggattacaggtgtgagccaccatgcccggccccaattgctaagtcttaggatttttttttttttttttttttgagatggagtctcacactgtcgtacaggctggagtgcaatggcaagatctcagctcactgcaatctccgcctcccaggttcaagccattctcctgcctcagcctcccgagtagccgggattacaggtgcctgccaccacgcctggctaatttttttgtattttagtagagatggggtttcaccatgttagccaggatggtcttgatctcctgacctcgtgatccacccgcctcggcctcccaaagtgctgggattacaggcatgagccaccgcacccagctgaatttttaagtacagtttttgaaagttgatgggtcctagccaaaaaagagaagttctggataaatttgatggtgactcagacaaaaatgagcataccatatgctctatatggaaacaagaaaaagtgatatttgaaaatgttttagccagtgctcaattcagaatttacgttaatagcattataaacgactttagttctgtttctatagactcattaggggtctacagggatcatttaaatatttcagttacactttactgcattttatgaggaaaattatatattataatgatacttggggatttgagaaggtcttgggacatatccctcatgaatatctaagtctcagcactagtagatttacttttccccaataatttcttgttaatttttcagtaattgcaaaaatttggcttacttagcttattatggaactctacttttttgaagatgcagagttttcttgcaagttattttaaatttgacagtaaaatgcctaaaaacttaagacttaagatgctagaggaactgcaactgctccagatgtacaagtgctagcatggggtatggttgaagttataacccctgctcttgctaattcctgctgcatggtcattgttcaactcatctgtctacattaaaaaacaaacaaacaaaacaatagcagaattacgggatttgtaacatgcatattgcgtggtctgtgaccataagtcgctttcaggctaggagcaaagacaaagtccgagtaatcaaagtattaatagaaggtggtatagagtagggactgcaacttgcaaagcaatgaaaagaatgttggctttggatcaactaagcctctgctttcctggctctgttgaatagcagctgtatgactggtgctgaccacatagtaggagctcaataaattataattataagatcagtgtcacaaactacagtagaatttagagaagagaagtcattttggatatcagtgctcagcagaactatttaaatttgtccttggagaacaaatagacttgatgaggcagacattagaggggaatttgtgccgccacctaagaatgaacaaaggtgctgtagggaacaagagagcccggtgcatattgggaaaagcactgtgtgtaagtgtgttaccacggaggttctgtgtgtgttggggcagtggggaacagacccaaagagtaggtttttaaaaaacgacagaatgcctgtcactgtgacaaacttctagagaaaatatttcctgtgtttttcatcatgctttcctttgcagcctgcatagaaaactttgctgtcagcttttgtagaggctgcttcctaaatttaattagaagatgtttcctaacagggaagcagagcctcccctcttctttccatggctgcagtttatctaatcaaactaagctcatcaaattcctggcttagttgttcttcacgctggctatgcatcacaatcatttatggagttaagtacacacacacacacacacacacacacacacacacacacacacacacgatgcctgggatccagaattcctgaagaatctcaggaaaaaggcagtccatgtaactgtttaaaagagcttcacagattccaatattcagaaatgattgcaggagaactttgagctcatatcaccttccttagaaattttttaaaacagggtgtgaaggtggaatctatttagatatgataatgctgtgtttctccatgggaatcactatatatttttccttaaaacaactgaatacataatcatcaggcattatttgtaaagatgtcaaaactcaaagagttccatttaccacagctctctctaacttagttgggtccccatagccctctgcattaccttttccactcagccaattcaacagataggtatcaaaataactctaaatttcttgcattttaaaataacatatgggaaaagaaaatagtacagttgctgctttacttcaaagaagtccacctgccttttgaaagcaaagacaacagagtcaatttactctttcatattttttgtccttctgttcctccccctccatcccagtgtttcaaggctacccagacctccttctccctttgactctcatgggcattttcctttgcccagtgtttcgtatccttgtccttcgtgtctttctctatctcttcaagtctctctttgaggtgactggtttcatattttagtcatgaagttataaacagcttaatagtttttccttataaagaatattcatattttaaaagaaagctccaaaaaagcaacaatgtgacagtgtctccacctcacagaatgactcaataatagtgcataattcaaacaccatggcacaataatagaagagatacatttgagcaagtaagcctttatggagtgcctcttgaattacacctggtaggctattcaaagcctgacccagaacaggtaaatgcagtatcaatgagcccaaatcaattttgaaagttttacagcagtttttaaaacataactgcaaagatgatttaaagaactaagtctagtaaaaccaccaggcatcaaacctgaggtgtcgatacctactaggttctcaataagtgtttgtagaatgaatggatgtactaacatatttaaatcatatcaaggaaagaaggctgggtgtgatggctcatgcctgtggttccagcactttgggaggccgaggtgggcagatcacctgaggtcaggagtccaagaccagcctggccaacaaggcaaaactctgtctctactaaaaatacaaaaaattagcctggcacggtggcgtgtacctgtagtcccagctactcagaaggctgaggcaggagaattgcttgaacccaggaagcagaggttacagtgagctgagattgcaccactgtattccagcctgggtgacaagagcaaaactccatctcaaaacaaacaaacaaatcatatcaaggaaagagatgtgaatcaggagctaggaaagctgagttctacttctgacttaggaacaaggtgaaaatggaacagcagagggtagaaactgaagtggtcacagagatgggattgaatggaaaaatacaatgttaaagaggtttcaaggagaagttataaataaggtcaaattctgtgcagtacatgaaaagggagatgattgtgaaaacgtgactggtgacacttctgatagtgttttgagcagagtaggagaaagcacagacagaaagagtttggagagtggaagcaaagaattttctgaatgaccagaaaggaaggaatgatgaaaaatagacaagtgtattgagagggtggcagaatcaaagcaatttttatcatgcatgtaggagaatgggaatggaccatgaagaggcagaaatgaaaaatgtaaaagctgaacagagagtaagatttttaagaagttgatgaggctcagattaagcatatgagtagggaagtttgtctccgaaaggagaagttcttctatctgatactgagcttaaagtacaatgccgagcagaaacaaatattcccaggtgagtcagagctgggaggaagcagaattcctcaggactctatcaaatacctcgtgttatgcttcctgtccaaacgaaagctactaatttcccactctccatccttctgccctgaccaccacatgctggctcacctctgtagtgtaacacatctcattcacctaggcctcctaagacagccctctgatttccactgttctaagacagaacaccttcaaacgagatcttagctgatggctgacctcctaggccttttgctaagaaactaccagggctaagttgaaggctcatgacttaacacattttttttttttttttttggaattggtttccagttaggagattgtctcaaatgaaagcaatacagatctgagtggaatttttaaaaagctgtatttccagagacactttaagtctggcagaatggcatgggattgcttaacagttgagtaccatttaactatgttaacatttatgactgtgccaatactgggcaagggttattccccggcaagaggacctgaagctgtggcactcagtctggctacacaaagaacttgctttatttcatgggaagtgagttgccactaaatctcccaggcagaatgggctctgtacttagtaccattgacaacttacaccttgattctctccttctccttttctaaatgtagtggttcctccattcctgtttgctaaatgtgtctgttattatacagtctatttgttacagagttttatacatgaagtatcaagacattatggtgtcattattttcacctgccactttaaccccacagctatttttactgagacattgggaaaattagattcattagagataatctaagcaaaataaaggtgaaaataaaaaaaattgtatacggtaaaacctttacacttggtggcaatatttaaaactgtgaaaatggattctaggaagatgggaagatgccagggtaagtcaacacttaaataagccaagtagtaccactgaagccttgagtttcctggagaagagagcaagtgtgaggattcatttatcttggggaagggagaagaacagaggtcccaacaggtctgaagctaatatatagcagattccttggccactggagactgcccagccacatatgccggtggagcttcgatcatccaaagaagagcacgtctgccaaggtctcacacagtccttcaggaggttgcctcatgcggctggtaggcagtcctgggagggtaggggtgatgcaataggtaggacaaaatgctacaagtttttatattttagaaggaactttgtcccccttggacctagagagtcttaggtcctggtcttatacctgtcccagtgaagaggttctggtatgctagggtgtaatcactagctcaccagacaaaattgccattgcacccacaaacctccagtttaccagtgctcaagaaaacctcaaacctggcctgttcttgtgtggcaaaatctacattacaaggaagtcaaagaaaaattgctacctatttcatgtactcttaaacttgtgggagggaggtcaagcttgaacaggtagctactattaaggaagagctaatgaatgagacagaggagaatgttagtttcaatgtaatgagtattctcaaagagatacaattagaaaataaaaataataattacttgaactaacaataatgattttcacagttctaaaatcaaagagaggaggtaaaaaaaaaagagagtagctactgctgagacctgaattaactgtctggatgaccaaaataaagggacaaagaaggaaattagtgataaaataagtgatttagaggaagatctaggtgacataacatgcaaagagaagtagttccagatggggaaaacttcagcttctatcaaatagaagtcataatcatggaaataacagaataaaaattctgttgaagaaaggcttgtgccttttgactgaatgggctcactaagactcagacaggattaattttacaaaaagccacacacctagacataatcagggaaaatgtctgacctccaatgctaatgaaaaaaattctttcttctactcagaacaaaaaatagttttcttacaaaagaaagattatgcgactatgttattaaaagaaaatgactgtcgcccaagaatctttataccagccaatcaatataataatcaaatgttaagaaaaaaggcacaatggttttcaacaatcaagaattcagaaaatatgccacccatgtactgatatcttatctgaagaaaatactcaaggaagtactcccaatctcataaaatttctaccagaagcaaatctcttctttacaagaagagcaaagcacaatgcagtgttaatacagtgaataaacagtgttaacttgttttagtttatgtgatgataattctataactaagacagaatagaaattataagacagtgttcttaaaatttatgtttgtgtgtgtgtttaattaaaacccgtaacaaagagctttcagctactcagaaaaatccaaaaattgtggagaaaagaaggaagaggaagtaaggtagaaaggagtttaaaagtctctaaaaaggtacagggagtagagattcaggagtaaaatgggcaagtaggctgtcttagtgtgatcattgtcattactgaactggatatactaagcgagaaatattgtttcacatattattgtgaatagcagaagaatgcaatttccaaattaagagacttttaaaaaaggaaaaacacccaacaaagtaaataaacagtaaacacaaaatattataataataagtaaataggtcatttaccactatatatgttaatggaatgaattatgaaaatagagaaaagaaaaaaagaatgcaggaatggaaatattaatgttaagaaaacaatgaaaactcaggtcaaaagcactaataaagataattagtgatataatgattacaggaataattctcaaagctatatgcataaactatatatcaaacaagaaaagacatatagggaaaaagtgggaaatgatataaaaacacaacgatggccaggcatggtggctctgcactttgggaggccaaggtaggagggccactttagcccaggagttcaagaccagcctgggcaacatagggagactctgtctccacaaaaaaagtaagaataaattagctaggtgttgtgatgtgtgcctgtggtcccagctactttcgggaggctgaggtgggaggatcccttcagcccaggaagttgaggctgcagtgagctgtgagcacgccactgcactccagcttgagcaacagagtgagaccctatctcaaaaaataaaagaaaataaaaacacaacaatgggaaattttaataggtatctgttagattttgactgatcagtcagattgaaaacagtaaatacgtagataagttgagtgatacaattaacttgcttgatttaatagataattgtgaaattatgtagcaacatacatagcacatgtatttttctcatatactcatgtgaattacttgacatacagttggccacaagaataccttggcaatttcccccaaaatagctgttttatacattgggttctttgactagaatttaataaatctaaatctaaaccaacagatgacctacctcacccctttatcaactgcttatatttgcaggaaagtgacagtaaaggctagttaccaagagaaattgaaggaggagtaccatgacattaggtccttgtctctggtcttcccccatgtcaggagtactgccattcctatggtttggctctgagtcaacaatttctcttactgggcttaggctagtttgccttcctttctgtttcatagcaaaaggagctgattaacacagggttctctctttttctctccctctgtctctgtctctcactacatatacatgcggacatgtatattgaattcatacaaataccttcaattacatcaagttgaattgcaaagcccctaatttactgcagatatgcttagattgatatttctatgcacaagacttgacaagtaaaattttttctcatgaatccttctctctcctaaagtaatataatttaaggaacagatctcctgaacacaggatatacataggaacccatggaattttcatctctctaagttcttttactgaacagagaccacaccattaaagaggaacattttgagttctctaggttagcatattaaaaaggtgaaatttacattaaaaactttttagttttaccttaccaaattaaggatccttatttcctttatgtcaaagcagataatcacgaagacctggtaagaacagctgactttctggtcagccattttatcactctgtttttctccttaaggaagattagcacatccttttctactgttagtgttctagtcatgctaacagtagctgcagaatcaagtctttcctagagaaagcctaactgtttcagtgttgtcctggagtcgattccatgttgagtgacatcaggttggtagcttgaaattggctatagtgagagaattcataacacagaaaccagcaacaaatgctacaaataggagatttgttttcaggagaactgcttcactagcatagtagttgttttgttccaggtagctgatctgacgaagtttagaatctcatactctagtgagaagaaataaactggggaaaagaagtattaaaaattgattatgttcttcttgagtcaatgaatttatttcagagaagtataattttttagaaaaataatggagtccttaaactaataattttggaaaatgttaagtgtgaaaaattgtcatataaaattgtaagctgagaaaaaatagtacttttgcttaaggcgacttaaatacatgatcttgtctactttcttccttttaatctcctgtattcttgtagtattgaatctttctagtttctacttcgaagaacaactaatttaatttttcaaaggatggttggaatggtatttcagtgaataagaatatttcatattgtgccttaataaaacttggaaacctgttattattataaggataaaaattactaaggctttttctttctagaaaatcactgaaacattcttattacttcatacagcttcacagtgctaagcaaagtcgacttatgttcttagtggaattaatcaatgtacagccaattataactagtagtaggttcagagttgacaaatatgcgtatcaaagtcatgtatggaaacttgaactgaaaccccttaatttacattccccaaatgtccagaagaataagaaaattaaaaacaaagtcaaaactgagcactgaaagtttagcactgatgaatgttcagaagtctaaaagatacatttgtgttgggagttgaagtcgtggtaagggtgctgtcagtggcatgcagggatctggcttcaaggattttgaattgtttttatttagtggcctttgcaattactggccttgccagctcatgaaggagcttatcatcactccccctaccacttaccatcaccaccactttgagaagaacaattcaatttatttttatgatagagcacactttttgatctctggatgaagtcagttacatctcctgtatttgacttaaaatttcaggagaggaaaaaaaaacactcaaagaaacaaacaaacaaacaaataaacaaagccttttaaaaaatactgtgaatcagtacatttccttaatgttataaaagtcttttgagattcttgtatgtgtgtgtttaattgtcccagctatcttctatgaactgagaaaggccttcttttgtttgaatgtgacagatcagttagaactgtggcaactaccatttacagctattgatttcaatgtgacattaaaggccccaaattccaccattattctcttcaattgtcacaaacaaaggttaataatagttgagtttggactgaaggaatcaagtaaagattgccaactgaaattacatgttgtttatctgaggcacaagtcagtatgagggtctctggtccctaggttgcatgtgtattatcattattttaaaaatatgccttttgctaaaagtaatatttaaaatacagaaaatgaaagtgtagtataagaaatcatgctatttaaaataaataatttaaaaaatatacttgtccttaacacagagtaaaaacattttgttttgttgcttctatagcagcaaaataatgtttctcataactgtaaaaagtggtatgtagcatgattaaacaatatttcaactctttagttcatgcagaggttaccagctagagggtagaaaggtttgattaggtttatgtcttccatgagaattttttttaaaaagcatacaactcccttaatatatgagtgctaaagctacaaatggctttcttttgtggtcaggtatgaaagaacaaagtccctttactacaataaataggtagaaaatagctagtgagatattataaatcttcacaaaagcaatgccaagttaaaaaagtctgtaagtctttaaaattttaactcgtttatatttatatcatcacttactacctatttactccaatggtaaatggtaaatagtttcatgtgctgtttccatggtaaagcttcttaaacaagcatcttattttttaaaaaattacactaataattgcaattatattaatacataattattcaatatttacatagaactgcagaattacacttattagtggaaaatagctattttaaagtattttatgaaaaggaaccctagattaagtaaatgaattgaggataatttattattggtcattatttcttaaaaataaaaaaaagagagagagagagagagaatctcgccaaaagtacttgctagtaaccattctaaggaattctagaagtagggcagtatgattccaaataaatatggtttattttttgaatagacagaccaacattcacgcttgagttaatgctatgcagtaccatttcataactcagaagataacaataaaacacacaggtgttgagaattgttcatatatagacaattgtacaaagaaatgaaagttctcctttcccagtaccagaggttctaaacactagtagtgttggtgtctattcttttcattctttaaaccctatgtttatatatgtacatctttatataatacatgtattattgttattttaacattcaatttttttctctttacattatatataatctatatatgtcaccacacacacacacacacactacattgatatatgcgaaaattgctttactttttccctttcattaagacatagagatctatctcactgttttttatagtgacagagtatcccattgtgtacatgccataagttactcaacgttctttaaggatggacatttgtctccagttgtgttattaaaaatggtgctaacttgaactacatgaaacatgtttatgcatgtactataatttttataggagagatttttagaattggcctgctgggactaaaagtatatgccatgaaatttacttagatgctgcaaaatgctttcccaaagggtggtactgtttcactttccactagtaaaatatgaaagtgactgcttccccacactctctatagcactaatggtaatcactctttgccaaattagttgatgaaaaatataatatctgtgttggtttaattcgtatttccattctgaccagctgggttggatatcttttcacgtttaccggccattggtaattttgcttctttaaattgtctatccatttttaaaaatctgaattgtttgtcattttcttagtaactggctaaaaatattttttcctaatgtcccattttcccctgcttacatgaagagtgcattatcattttaaaaaatacatatggacaaaaagaagatgaaaactgtccataatatttttggtgtatattctgacattagtgttaaagatgagatggaatcatgcttcccattctatttgtcattgcttttcttcactcaacaaaatgggctctacatttttgtatacccttaaatgttcattcacaactatgctttttaaactttgtgatcaaaacaaaagtaagaaaacattgaaatcctttcaccaagcaaaatttcattttgaaaacacaaaaatggagtccaagtggaatggctcaatcacctttccctcataactcatatcctagactggataacggtgactgtcgggatgcgagaaaatgctttttaattgacaggtagaaaacagcaggaagaaaagtgatgggtacctcacttgcaattatgtgtgtaagaaggcttctagtcttgattacaactccatgagatgaatgctgttattaacccattttacagaagacaaaatgagtgcaaagtcacttgctttatatgataacatatagtatgcatagcatttgaattcagcaatccagttctgaaatatgtgctcttaatcactatgaaacctgcctaatagaagtacacaaacaatatttacacttgggtcatattattttaatgattttttttacaagactttcccaacatgttgcaagaactgtaaaaataggtttaaaattttgtttaatgcagtaaatgcaaaagaatatttataatacatatattaggtaaagtaagtttttatttctcattcctttgcttttaaaagttttaccatatacatttatatctccaaagaacatataatttagtattaaatgtttttatcttccatatacatgaaataatattcttccttattcttcagcaacttcctttgtcaatctgacattatatcacagagatttatttatgttttccatatagccatatatcattcatttttattgctacaaagtattccactgtataattacaagtctttttatctcttctaccataaatgggcatttggttgtttctagtttttaaattattactatatcttctcttaagtggttgctcgatcctttttttagtttttatattgagttgtcttccgcttctgaatttgaagaaatgcatatattctaaatatcactcttctgtctcttgtttgtagaacaagtgtttattcctaatttatatcttgtcttttcgttttcctcatggtattttttgattaagaaattttaacaaacttttatgatctctgtattttctgccttgtttaaagaatccttatagattataaggtccataaggcatttttctatactgtttttgaaacatttaccgtactgcctatcacataaaggtctatctacttaaacttgatttttatgtatagataatgattgtcttactagtatttagttaatagttcaaaattttctcactggtttgtaatgatagctcagacaaaaatcaagcttccatatctgtctgggtatctttacgagttctgtgttctgcgagtttgctcaatttatccaactgtgtgtcaaaacccctatcttaagagatatagctttataagaattgttgaaagtggttatgaccaagttaatatatgttaagtgcttagaacaatgtctagcataaatgctatataaaatattttattttattattattattgaatgccttggtgatttggggccttttaaacatccatataaatatataaatcagtggattcttttggatattttttatagattatcagaagatatgtgaataatgtcatttttcccaatcctgatattttcattttttatctctttattttaaattcatttttcaagccttactgtattggcattttatatctagtacaatgtagaatgaatatgctaacagcaggcacccttgttttatttctgattttaaagacatgcttaccacatttcactattaagtttgatgtttgcagcagatattttgcaaatatctttgatcactttaaggaagttccttcctattcacaattttctaagatgtttttaaaattatgaatgaatcttgacttctaccaaacatattttccgtatctagtgagatgatcatataatttttctgctttaacttgttaatatgatgacttacatgacatgatgttttctttcggttaagccaacctggatttactgagataagctccatgttgtcatgccatattcatctttttaatcttttaatatgttgctggattctgcatgttaacattttgtttcatatcttgcattgatgcttatgagtgagactgacctataatttcttttcttacactaatctttcaatatcaaggttgtaccgggctcataaattgagggagtattgtgtttttttattgactgattgttttttcaattgacagacaaaattgtaggtatttatcatgtacaacatgatgttctgaagtatatatacattgtggaatagctaaattgagctacttatatgcattatctcacacagtcttcattttttgtagtgagaccacaataaacattctcagtattctcaagaatacaatatatcattttttttgctatagtctgtaatagcttaaaacctttcctcctgcatttctgactttctaaagcctgtttggaaggccagctttctcttgtgtactgaaaaccaatctcactggaatgctggtcagccattctacagttaaaatggaaattaggaatctttttgactaattagatttcaaatagcttttgcttgtacagtatattcatggatgttaagaaggcattgtcacaattaaggtttttgagaaaatcctttccaagaggatgttttccatcaacaaacagaagaaaaattaaatgcccgattaacaaacataatgtcctctttaataattctcagcactctggtaattctgttaatattactgtgctatatctacagttctttccttttgtttcatgttctgaataattcaattaaaagtctgacaaagcaataacaagggattgaatgctgtcgaatcgtaatttgaaataaaaacataagctctttgggaacacttatttaaaattctgcaaaaccttttcaagtatctgagattgttgcattctacaaaagaaacagttaactacttagctaagttatcctgcttcctttcttgtaaccaatttccgtaaataaggaaaacacagttgtgtaaaacaatgaagttcttgcaaaacagaccactttgtctgcacctggcttacatggaaggaagaactattcctttttcctgaattttgaggaaaaacagtggcacagcttgagtactgaacagcagaattgcctggaaggctcatccacagggcctacaatttctgtccttttatctggaaaatattaatatacaaggtaatgtgagggaaatgaaaaagaatgtgataaagaccttgcccttagaaagtggccactctagtaacagagataagagctgtcatgtgtgacacaatctcatgcagttggcggacagaagggagccagaaggtatgaaggggaatattgatccagatgttaaagccataggcttcaacttcccctcccccaatatggacactattctgcttcagttctctgagctgtcatcagaattcatgataaggaaagacacagtgaggaaatcacttattctgacatcaagaagaaaagcaagtaatataacctggtgtcattttacagaaaagctacggagtagtgattaagtgtacagtcctgtagtacagaaacctgtggtcaatttctggctgtagaatttcagccaagttgctcaacttttctatcctgcagtttcctgatctagaaagtacgaataatagtacactagctcagagagttgtttgaggattaaataatataatctacttaaaatgttaaccatttcctggcataaaataagctctcaaaaatgagaaccatttaatattatcaatgtgagccaatcctacaagttcttactgaagaaagtagcaatgattcttttttttttttggagttatttctttttattaattttattattattatattttaagttttagggtacatgtgcacaacgtgcaggtttgttacatatgtatacatgtgccatgttggtgtgctgcacccattaactcgtcatttagcatttggtatatctcctaatgctatccctcgcccctgcccccaccccacaacaggccctggtgtgtgatgttccccttcctgtgtccatgtgttctcattgttcaattcccacctatgagtgagaaaatgcggtgtttggttttttgtccttgtgatagtttgctgagaatgatggcttccaggttcatccatgtccctgcaaaggacatgaactcatcaatttttatggctgcatagtattccatggtgtatatgtgccacattttcttaatccagtctatcgttgttggacatttgggttggttccaagtctttgctattgtgaatagtactgcaataaatatacgtgtgcatgtgtctttatagcagcatgatttataatcctttgggtatatacccagtaatgggatggctgtgtcaaatggtatttctagttctagatccctgaggaatcagaaagtggcaatgattctaaaagaatccaaaaaaaaaaaaaatgctgcagattcaaacaagagaaatgctatgtaagcaaaaagagaagaaatatgtaattaaagaaacagaaagacaaagttaatttttaagcaaaattcagtgagagaaaccagtctcagagctgaagaccactcctcttgtaggctgggaaacagatagaggtaggagtgacaaagaaggagaccaaagaaaaagaaaggaagccatgggaaaattgaaatctgctttttaactaaaaagaattaaactttattgtaatactggctgggatatagctggtaaggaggaacatattaaatactcaaaccataggcttttgtccaaaatgtcttatttaaacagttttctaatctgaagtttagtactaatctgaagcttagtactatatacaactgatacttaaaaataatttagtcattcaaatttacttacattctttctatgcttacaatttataatggaatgtgggttgctcataacatttttatatttactcctccatatataagactgaacttttgtaggcagccatcccatttgacaaatccaaggtgacctaaaagtttaggttacaggggtcagtgaaataaattaactgatatattaatagcttattattggagcagttgtgtttaaatatgacaggttttgtattaaaactggcactagttaagcacagccagaacagagtttcaattattaataatgctgtgagtcacaaaatcagaaaaaatttaaaaacatctgacatagttgttcagggttgttttacatactgactttaaaatgtaatcatttacccaagtgtttatgttataactggaatctggtcaatagaaatgcaatatgagattcaacagcaaccgatactgtgtgcttttaaaaatgagtgtgtcatgtcaaagacttgtaaaatgggagcagtgccttaccaaggctgagtcttttagtaatgaaatgaatgaaactctatatggtgaacttatagaaaagccactatgtttgatgcaattggctacaggaagtcgtggccttcaggaaagaatctgtgggaggtttgctgaactttgtatctcctattcagccactataaataatttccctgtgacatcctctaaggaagcaagtgtccccgttatcacatttgcttatttattttcagtttattatctctctttcaaaacttcatagctctttatatctgttcctccctcttctccaaaccgagaagagagtaattaaaaattagaagtttgaaatatgtaagatctaacatgaacattccactgcatctggaagctgacagggcaactgacttattcttgcaggtgcttaaaatgaactatatgacaagttggagagtttactctgaaagcccaattagtaaaaataaaatgagagaagatgttcccacggcgtttgcaaaatgatattaaaagaaccaatgtttcttttaaaaataagcctgatacaggaaaaaggtaaagggcagaatcaaagtggcaagaaaagaaaaaaataaatcatggaatgaaagaaacactgaactggaaatttagagatatgaggtcaaggggaaaggttaaaattataaaggacatgaatacagagatagaagaaatcatgtccgtggtagaagacagtacactaacttttttgagctactatccccaatcttatttaaaataataactacaacaaaaataaaaacagcattaatcttagaatacaataaggcaaaaaatggagaattagcaaacacgatagggagagaaacaaaatcaaacgtgtttcaggagaaacaggattagaaaagagaatgtttataaaagaggaaatcagtcaggcaaataaaagcaaatggagaaaaacatttaaaaggaacaaggaactcaataccgtaaaagaagaattgaattgcagattttgatgtaactcacttatatttcataactatacatctcaattcaatttaattcagctactgcaagtattacaaaaatttgtagccataccagaggtggagattactatttttatttcattttgagtgtgacacaaaaatggggttaaagaatctggcacattctttggtattcactgccaaggaggtttgaactttctaaaatgatgcagtgagattttcaagcagaaaaaagtccttctcaaataactctaaataaaaagaaggagctctagatccaaagggatcaaggaagtgaaagtggaggaggtcagacaacaagtgccaatgtggcgtgtccacacaaagaggaaagaaaaattgggaatgatggacataaccaactaaggaatataaaagattgaacaaaacctaaactgatggttcccagtgtctctaacatctgcatgaggcctgctacctaatagttgctcaattaataactaatgaattaaatgaatcagtgaattaactgaattccacttagtggaactatcttttcaggctgtactcatcagtgggaaacaatgaaagaatgagcagacagctggatttacaagaaatagtgtcaaaaatttgtcactttggaaaagacttgctcttggagaaaagaggaaaatattgaacaacctgaaatagtaaaaaaaaaaaaaaaatcttacagattctatgtgaactgatctacagggaagaaataggtctacactgttttcaaaaaaaactactctggttgtttgatttttttttccccttccctactttgtgggatgatgtttgattgttttttattgccatcagcattggcactcctccggacacgtgtttggggttcttggaaccaaaatgaatagtacatacagtaaagtgcacctttcgtgaagggaaaatgacaactacataacaccatgtaaaagaatgcaggcaaaaagagaatttgtttttctgtattatatgagacaataaggcggaaagagaaagaaaagtaaggcaaacgacgcatgacagaaaggagaacaaggctcagaacacacaagatcaagcaaggggggtgggggagcccatgaaggcagaaacaaggtaacaaaaaggacaaaaccagcagtagaaaagaactgtcagacacaaaaccctcaaaacaatagataggaaaaaaaggaacaagatgacaggaaaagagcagcatggaatctagtaagaaaaagaaacaaaaatttcaaataatggattttctaacacccccgctgttcctccagtgcattgtgtcacagtctcacagagcagtgcataatttattatggtcactcgctgccaggctgctataaagggcagtagctatatgaaaatactcctcactgcctggatggcttaatgatctaccatttgtagaggggcagggctgcggaatggcaggcaagggcaggaggagcacttgtggtgctggatggcgctctgcatatttagtgcttcccaccgtttgaagaaggggtgtattaactctcaagacacctcggtggggttttttcccccttttaaagcctttcctaaataataaacttctgtccagagcagtttcttaatctgaaactacatataccctcctttaaggcaggggtcatgtcaaagtaaacaaccaccaaaagatggattttaaacataaaatctgacttggacaattaacattaataactggaaaactgcattctgttttttttttttttttctatgctacagtttctctttagaaatgaattttgggtgcagaaaaacttaaaagtctcaaaaaaaatagagaccatacaaatcattttcagcaatcattttccagaaactggacttttcggtagtatttatatagaggaactttcataacttccacaaatagcactgtcttcaaactgaaatgcatcatcaagatatctatcaataatttctgtgattgataaagccagggattacttctttaaaattcttctttgagaggcagtcatgtctgagggacaggagcacaggctcttgagccagatggccgagatttgggtccagatgaggccactgacttgccgtgtgaccctgccatgttacttaccctttctgagttccttcatctgtaaaatgggaacaataatagtaaatatatcatagaattgctgtgagaattaaatgaattagcccttgggtgagagcctgctaaacaaaaagcacggcaggtgtcaggtgttgtacctgctctcaacaaagcatgatgggacattagggcatttgtaatccagaaccgttcgccatttggtcataggcatagagacagctgaaaagtgcatcccttaattccacaaaagaccaggctagacagtgcactttctctttctgtcctctcatccttggatacaacccttgcttatataggacaacagatgtgtaaaaggaagtcacagtcagctgttttgacatctttcatcctccaaactcctatagtaaaacgcaaaatgcaaaaaatgctcattcttaaacaaaatgatttttgagttccaaagataaaatattttgaaaaagatggtccagatcacagaaaattgttaataatatgcatatataagtagtatgtaattctggacaaggacaaacatatttaggttggagaaatcagacatgtgaagcttaaaatagtagaaggtggaaagatagcaaaaaatcagaacaagttatggagagtggtcacagaaggaagaaaattaatttgaaatgtaagttctcaatttaaaaaaatcagaactactttcctgggtcatactcaagaacaatccttctcaggatcttctcactgccaatgacacgaaaagacattttgtgtcaaaggtgaattcattcaattatccactcattcattcgttcattcattaatctatccccaaattatttactgaatacctgccatgtatcacattaatcacattaatccctggagaatcaatggggaacaagtcactctaccatcagtttctttatttttcatgtggagaatattctatcttccccctcaaagttgattgaggaatgaatgtgatcccatgtgtagaaataggcactttgcctagaatacaaagggaactgactgaataaaatcagtttctaatcaccataaaaatcatttatgaatttattattttgggatatatttacatcatgataactatacttttattgcaatcaccttaagacacacttatttactacctaaagggaaactatatttcactttatgtattctaaatctatcatctctataggaataataggtatatgtttaatattcaaaatctttcatttttgaaattttattttttaataattgaaaaattattgttgtatatatttgagttaccaagtgatgttacaatttatgaatacaatgtatacgttaaaattaaatcaagttaattaacatatccatcacctaaaatacttactttttgtggtgagaacatttgaaatttactctcttagcaattttgaaatgtacaataaatggttatttactatattcaccatgttttacaatatatctcatagtaaaaagaacccttattattcctgtctaattgagactttacatcctttcaccatctcctccctattctttgaccatcttctccctattctccccaccccgagcttctggtaatcaccattctactttctgtttctttagttttagattgtttcattgttttagagtccacatgtaagagaatatgcaatatttgtctctctaggcctgccttccttcacgtaacatgttctctagttccagtcatattgttccaagtgacacaatttctttcttttttaaggctgaatagtagtccattgtgtatatataccatattttctttatccattcatctgctgatagacacttaggttgattccataagttgcctattgtgaatagtactgcaaggaacatagataggcatgcagacatttctttgataagctgatttcaaatctattgcataaatacccagaagtaggattgttggatcatatggtaattctacttttggtttttcggggaacttttatgatgtttccataaaaagtatactaatttacatttccaccaacagcgtgccagggctcccttttctctgcatcttctccaacacttattatctgttgtctttttgataacagccattctgacaggtgtgagtgatatctcactgtggttttaatttgcatttacctagtgatcaccgatgttgagcattttttcatatgcctattggtcatttgtgttatttcttttaagaaatgtctattcagctcccttgctcattttttattcaaactatttcttttctttccaaagagttgtttagtctccttatatatatttgatattaaccccttatcagatttatggcccaaaaatattttcttcaaatccatgggttgcttcttcactctgttaattgtttcctttgctgtgcagaagctttttattttgatgtaatccaatttgtctatttttgcacttgttgcctgtgatcaggtagcaatatttgctgttctgcaatatttgctgttctgcagcctccgctggtgacacccaggcaaacagggtctggagtggagctccagcaattaaaaaattaaaaaatcattatctagaccaatattgtgcactttttctcctatattttcttctagtagttttacagtttaaggtcttacatttacctctttaatccacttgataatatttctgttaatgctgtgagataatgatctaatttcattcttctgcacatggatatacatttttcacaacaccctttaatgaaaagatgtcctttttccaatggttatacttggcacccttgcttaacatcaattgactatatatgaataggttcactgctgagttttccattctgctccactggtcaattagtctatttttatgccaacatcatgctgtttaactaacatcacttggtggtagagttcagaatcagttagtatgatgtccacagctttgttctttttgctcggactgacttggctattcagggtttttttgcagttccatacacattttagaattatattttctatgtctatgaaaaactatattaaattttcataggtattacactgattgtgtagattgctttgggagataatatgaacattttaacaaaccaattcttctaatccatgaacacaagatatatttgtttttgtatctttttcaattgctttcatcatgttttacagtttttagtatatgggtaagtttctcacctccttggttaaatggattccttttgatttctttttcatatagttcattgttaatgtacagaaacatcattgatttttgtttattgattttgtatgctgcaactgtgctgtgttaatttattagttctaacagtgttttttttttttggtggaatccttagtattttctacatataagatcatgttagtaaacagcaacaatttgacttctgcttttcctatttgcatgcatttaatttctttctcttgcttgattggtttggtaaggctcttgcttgattggtctggtaaggacttccagtactatctttttaaaacagacttacgggatacaaatgcagttttgttacatggatatattgcatactggtgaaatctgagttttctgtatagccttcacccaaatactgcatattgtacccattaagtagtttatcataccttaacccttttccacccttccacccttctgagtctccagtgactattattccattgtctttgtccatgtgtacaaattatttagctcctgcttatgagtgagaatatgtttccgtttctgagttatttcaattaagataatgacctctaggattccattctgagatggccgaataggaacagctccgatctgcagcttccagcatgatcaatgcagaagatgggtgatttctgcatttccagctgaggtacctggttcatctcattgggactggttggacagtgggtgcagcccactgaggatgagctgaagcagtgggggtgtcacctcacctgggaagcacaagtggttgggggatttccctttcctagccaagggatgccgtgagagatggcacctggaaaaccaggacactcccacccaaatactgtgcttttccaatggtcttagcaaatggcacaccaggagattatatcctgcgcctggctcagtggattccaagcccaaggagccttgcttatggctagcgcagcagtctgagatcaacctatgaggcagcagcctggcaggtggaggggcatctgccattgctgaggcttgaataggtaaacatagcagctggggaagctagaactcggtggagcccaccgcagctcagcaaggctggctgcctctgtggtctccacctctgggggcagggcatagctgaacaaaaggcagcagaaacttctgcagacttaaacatccctgtctgacagctctgaagagagcagtggttctcccagcatggtgtctgagctcagagaaaggacaggctgcatcctcaagtgggcccctgatgcccgtgtagcctaactgggagacacctctcagtaggggccgacagacaccacatataggcagctgcccctctgggacgaagcttccagaggaaggatcaggtcgcaatatttgctgttctgcagcctccgctggtgacacccaggcaaacagggtctggagtggagctccagcaaacttcaacagacctgtagctgagggacctgactattagaaggaaaactaacaaacagaaaggaatagcatcaacatcaacaaaaaggacatctacaccaaaaccctatctgtaggtcaccaacattaaagaccaaaggtagataaaaccacaaagatggggagaaaccagaagagaaaagctgaaaattctaaaaatcagagtgcctcttctcctacaaaggatcacagctcctcggcagcaacagaaaaaagctggatggagaatgattttgacaagttgacagaagtaggcttcagaaggttggtaataacaaacttctctgagctaaaggaggatgttcgaacccatcgcaaggaagcttaaaaccttgaaaaaagatgagatgaatggccacctagaataaacagtgtggagaaaaacttaaatgacctgatggagttgaaaaccatgacacgagaactacgtgacacatgcacaagcttcaatagccaatttgatcaagtggaagaaagggtatcagtgattgaagatcaaattaatgaaataaagcaagaagtttagaggaaaaaaaagtgaaaataaacgaacaaagcctccaagaaatatgggactctgtgaaaatatcaaatctacatttgattggtgtacctgaaagtgatggggagaatggaaccaagttggaaaacactcttcaggatattttccaggagaatttccccaacctagcaaggcaggccaacattcaaattcaggaaatagagagaacactacaaagatactccttgagaagagcaactccaagacacataattgtcagattcaccaaggttgaagtgaaggaaaaaatgttaagggcagtcagagagaaaggtcgggttaccaacaaagagaagtctatcagactaacagtggatctctcagcagaaactctacaagccagaagagagtgggggccaatatacaacattcttaaagaaaagaattttcaacccaaatttcatatccagccaaactaagcttcataagtgaaggagaaataaaatcctttacagacaagcaaatgctgagagattttgtcaccagcaggcctgccttacaagagctcctgaaggaagcactaaacatggaaaggaacaaccagtaccagccactgcaaaaatatgccaaattgtaaagaccatcaatgctaggaagaaactgcatcaagtaacaggcaaaataaccagctaacatcataatgacaggatcaaattcacacataacaatattaaccttaaatgtaaatgggctaaatgttccaattaaaagacatggactggcaaactggatattcaagacccatcagtgtgctgtattcaggagaaccatctcacatgcaaagacacacataggctcaaaataaagggatggaggaagatctaccaagcaaatggaaagcaaaaaaaaagcagaggttgcaataatagtacctgataaaatagactttaaaccaacaaagatcaaaagagaccattatgtgatggtaaagggatcaatttaacaagaagagctaactaacctaaataaatatgcacccaatacaggagcacccagattcataaagcaagtccttagagacctacaaagaaacttagactcccacacaataataatgggagattttaacaccccactgtccactgtcaatattagacagatcagtgagacagaaggttaacaaggatatccaggacttgaactcagctctgcaccaagcagacctaatagacatctacagaactctccaccccaaatcaacagaatatacattcttctcagcaccacatcacactaattccaaaattgaccacatagttggaagtaaagcactcctcagcaaatggaaaagaacagaaatcacaacaaactgtctctcagaccacagtgcaatcaaattagaactcaggattaagaaactcattcaaaattgcacaactacatggaaactgaacaacatgctcctgaacgactactgggtaaataacgaaattaaggcagaaataaagatgttctttgaaaccaatgagaacaaagacacaacataccagaatctctgggacacatttaaagcagtgtgtagagagaaatttatagcactaaatgcccacaagagaaagcaggaaagatccaaaactgacaccctaatatcacaattaaaagaactagagaagcaagagcaaacaaattcaaaagctatcagaaggcaagaaataactaagatcagagcagaactgaaggagatagagacacaaaatatccttaaaaaaatcaatgaatccaggatctggctttttgaaaagatcaacaaaattgatagaacgctagcaagactaataaagaagaagagagagaagaatcaaatagacacaataataaatgataaaggggatatcaccacggatcccacagaaatacaaaccaccatcagagaatactataaacgtctctaccaagtaaactagaaaatctagaagaaatggataaattcctggacacatacaccctctcaagactaaaccaggaagaagatgaatctctgaatagaccaataacaggctctgaaattgaggcaataattaatagcctaccaaccaaaaaaagtccaggaccagacagattcacagccgaattctaccagaggtacaaagaggagttgataccattccttctgaaactattccaatcaatagaaaatgagggaatcctccgtaactcatcttatgaggccagcattatcctgataccaaagcctggcagagacacaacaaaaaaagagaattttagaccaaaaaccctgatgaatatcgatgcaaaaatcctcagtaaaatactggcaaagcgaatccagcagcacatcaaaaagcttatccaccacgatcaagtcaacttcatccctggcatgccagcctggttcaacatacgcaaatcaataaatgtaatccatcacataaagagaatcaatgacaaaaaccatatgattatctcaatagatgcataaaaggccttcaataaaattgaacagccttcatgctaaaaactctcaataaattaggtattgatggaacatatctcaaaataataagagctatttatgacaaacccacagccaatatcatactgaatgggcaaaaactggaagcattccctttgaaaactggcacaagacagggatgccctctctcaccactcctattacacatagtgttggaagttctggccagggccatcaggcaagagaaagaaataaagggcattcaattaggaaaagaggaagtcaaattgtccttgtttgcagatgacatgattgtatatttagaaaaccccatagtctcagcccaaaatctctttaagctgataagcaacttcagcaaagtctcaggatacaaaatcaatgtgcaaaaatcacaagcattccaatacaccaataacggacaaacagagagccaaatcatgagcgaactcccattcacgattgctacagagaataaaatacctaggaatgcaacttacaagggatgtgaaggacctcttcaaggagaactacaaaccactgctcaatgaaataaaagaggacacaaacaaatggaagaacattccatgctcagggataggaagaatcaatatcgtgaaaatggccatactgcccaaggtaattcatagaatcaatgccatccccatcaagctatcaatgactttcttcacagaattggaaaaaactactttaaagttcatatggaatcaaaaaatagcccacataggtaagacaatcctaagcaaaaagaacaaagctggaggcatcacactacctgacttcaaactctattacaaggctacagtaaccaagacagcatgatactggtaccaaaagagctatatagaccaacggaacagaacagaggcctcagaaataacatcacacatctacaaccatctgatctttgacaaacctgacgaaaacaagaaatggggaaaggattccttatttaataaatggttctgggaaaactggctagccatatgtaggaagctgaaactggatcccttccttacaccttacacaaaaattaattcaagatggattaaagactcacatgttagacctaaaaccataaaaaccctagaagaaaacctaggcaataccaatcaggacacaggcatgggaaaggacttcatgtctaaaacaccaaaagcaatggcaacagaaggcaaaattgacaaatgggatctaattaaactaaagagcttctgcacagcaaaataaattaccatcagagtgaacggacaacctacagaataggagaaaatttctgcaatctacccatctgacaaagggctaataaccagaatctacaagaacttaaacaaatttacaagaaaaaaacatacaaccccatcaaaaggtgggcaaaggatatgaacagacatttctcaaaagaagacacttatgcagccacagacacatgaaaaaatgctcatcatcactggtcatcagagaaatgcaaatcaaaaccacaataacataccatctcatgccagttagaatgcccatcattaaaaagtcaggaaacaacagatgctggagaggatgtggaggaataggaatgcctttatactgttggtgagactgtaaactagttcaatcattgtggaagacagtgtggcgatttgtcaaggatctagaactagaaatatcatttgacccagtgatcccattactgggtatatacaaaaaggattataaatcatgctactataaagacacatgcacacatatgtttattgtagcactattcacaatagcaaaaacttggaagcagcccaaaggtccatcaatgataggctggattaagaaaatgtggcacatatacaccatggatattatgtagccataaaaaaaggatgagttcatgtcctttgcaggatcatggatacagctggaaaccatcattctgagcaaactagcacaaggacaaaaaaccaaacactgtgtgttctcactcataggtgggaatttaacaatgagaacacttggacacaggatggggaacatcacaccccagggcctgtcatggggtggggagcagggggagggacagcattagagaaatacctaatataaatgatgagatgatgggtgcagcaaaccaacatggcacatgtatacctacgtaacaaacctgcacgttgtgcacatgtaccctagaacttaaattatacgtataaaaaatgataatgacctctagttccatccatgttgctacaaaagacattatttcattctttttatggctgagtagtattccatgatatctatatctatatctatatctatacagatattagaagagaaaagatactgttatcccttcatatatcaatttcttccatgttacccaaaacacaattacaggaaaaacaggagtgccaagcctgccatgttgtttacagttttggtgtggtcaaggaaagaaaaaatgttggcaaaggaaaattgcaacaaagttttccattcacttaatagaaggttagacattttacaaataagagaagaaagctgcatgttcttttctgatgaatcatgaacacatactaaggttaatggaatttgcaacctatctatgaggactttcaaaactgaatagacccagtagcaacaaatagggagaaaggggcaaaaactcaagcaatcaatcctagaaaaaaataaataaataacatgaggaaagagtcaaagatgtttaagacatctcaaagacagtaaaattgtaattcatgctttaaattgatttttccttaaacaaaacttttttttggagagtacatatattcattaagcatactgatacttaaagtgcttttggtgagagaacaaaaacaaagttaggtataaaacaaaattttcaataagatctctgcaatataaacaatgtcaagagagacttcatgttggtataaaatctgtgattatcaataagcaccacctcgtgtttgtctggggggttgtaatagttctcagagaatatggcttccccaatgatcatgacaaaagagccttcagtcttcagccaatactcctaagttgtaaaatgccgtaattttaataactttatttttcttgacttaccttatctccttctctagtcaggcaaatccatacgcctccttcctgacagctcacctatcgcagttggaaaccttaaactgactgcaccataaaagactgactacctcagcaggaagcgtgtacaaatttctctttgcggtagaagtaccttaattttaaggtctttgtgaaggtggtgcctctgataccttcgtttaatttgtcttattccttatcttctctcttgccttatcttgaactctgttggctctactctcagccgctgagtacttactagttttctggtccaatattgctttttagcctgaaatgcagtctcctttactctcgagtcatttgtggcttctaatacatgactcagtcttgtccaccagttcttccaatattctaggccagtcagatcacgtaactagaccctcccttttcctgccaatattcatttcttagcaatcttggtgtcccaccttgtctctactctgccctgacaatctctattattcttctgtgacattacattacctgaactcttcatgaaatcatgaactaagaccatagcctctcctccatctcacctctgtctctgtctctctttatgacatttttatttcatccttatgctatagtcaacaaatacatagagaattctgctatatttctcaaactcactgtgatgtgaacaaatatttgagggtgatttttaaaaaacttaaaaaatacttttgttgcttatttctggaataaaacaaatgagaacaataaaaaccaagtaagttaaaaaaatccatagttagctgtttttcctgtaacattcaccaggctggagtgcagttgtgtgatctcagttcaccgcaacctccgtctctcaggctcaagtgatcctcccacctcagtaccccaagtagctggaaacacaggtgcacaccaccatatccagctaatttttgtgtgtgtgtttttagcagacacggggtttcgccatgttgcccaggctggtctcaaactccttagctcaagcaatcttcctgcctcagcctcccaaagtgctggcatacagtcatgagccaccatgcctggcctatatataatgttttttactgccacataatggttgggctacacaaaaacaacaatatttcctgacctagaactgataattcagttagatttaaacggtgttgctttcaactaaaaaaattacaacttttaaaagcagcaaaaatttttacatcattaccaacattaataactataattgaaaaactcatagagaaccagctgtaggcaaaatattggcagttacataaatgtctcttacagatttcctgtagtttatctacttatgtaagcacccatgtctatcaaatggctgagaattaaaatcaaataaaaagttgggcaacataatatagtataaagcagattttttttgattagagatagtttttctcataaacaagtggataatttattttaaagaacttcaaaaattataatgctatgaggaaaataaaataggatgaatccaatgaatatggctaacatcagattttagtcacttttgcagaagcttataccacacagtcatttctcatgtttcttcatggaactatgttatttcatagtgcaatgattttcaaacccataaaagtgatgcctcaggggatcatcccactgaggccaacctagtctatcccatacttatcaagtcaaatcatagacctggagttccaactctctagcccaaacctacatgtgtccatgctgattccggcataactaaacatcacattcaggataattctccacatacatagctcatagaggcttaagtcacaaggaatgagaagaatcaagaacctgcagaagatgtctcaggagcacatacctaatcagtatcaaaaagcgaacagaactcagcagtgatcctcaccttagattctccatgagatgccagggaggctactgtggcttaagtttgttgtattttacaagtgctggggctcccacattcttttctctaacctttgggatttcttatattcccaaactcctgagtttcaactctgggaaatatggaaaatactatgacttttcagctgttttggttttaaaaaagtgtcttcatattgtctcctccacagacatctatgggggtctgatccaagcagggctgtggtcattgctccctggacactgcattgcatatgagatagagggtctgctaagccagctgctgaaggaagactttatttcccaggggaaattctagcacatctggggcactgtggtcctcacacttggtttggattctcttcctgatgacggacgtctgctttctggcaagggtaagagtaataatctgtggttaatgtctaatgaaaaaatgctggcatgttgaaacagaaacaaagcctctctcttttttttaaaaaaaaaaacatacagttttatgcaaattaagtttgaacatagaacagatcgtgaaagaattatcaaagtattgctctgggtggtatttggagtaataatctttaaaaatcaattttaaggtttaccacttttaaaccttttattcttgcttagctaaatcgtcatgaaagcaggacttcatacatctccctgatgacaaaactaatgtttggactgtttgagttgaacattctaatatttaaaaattctatgcatagaattgaacaatatgattaaacgcaggaaggggactgtgaggtggcaagatataacagatgatagcggttgtactgccatctttgttcaggtccttatttgcctgtaaagctacggcagtcttctctctgattatactatcatttttgaactttctatccaaagaaatcattactaaatgagtgtatactaaatagttgttcactctttagcaatcatacctacaatgaaggcactcaaaccactgaacaattggaatccatcgagggctagggaaataacatctttgtagcctcttggaactgttaggtaaagaaatcaaattctttgacagtgattcaagctctaggtcactacagattcaaatgtgagtatgcactgggtttctatctttaaaccctttcacatatattcttcttccttcctcatggaaagtttgattgactgataatatacacccagctcatgaattagaatgtcatttgaaatagaattagagaggtgatttccatttggataattccagctgagaaggtataaattccaagcagaaggaataataattgtatgcaaaaaggtatagtagggagtagccagggcaatgcgttgacttttcctgcttgaccagaaactttgatacgccaaaataacacagttgggaatactagacagaacactagacaggggtcagtaacaaaggcactaaagctgtgggacttgctacttggttaccttaggctaaggcagattaagcacttttctggtccttaattcctatcctgtatataagggagatgaattggaaaatctttaaggttcttctcagtcacaaaattctgtgctttactatgccccgtcatcaactcaaggaaaagaagtaagcagctttaggttttctgatggcaggaaaaagaaaatcatcccaagagggttatatgactagcattgagaagtcctgtggagcatgctgcatcttgctcttctttattgccatatggaaggcaaggcctcttaccacatatctcactccatttatagctcctgggcaactatttttcttttgatagctgatggaaggtctaagaattaaaggtactgctggccaaagaaggcagcccaaagacaacaatgtcaggaactcagaggttcagtagaactcctggggaaggttggtcttgatattaaaaggtgaatcagaaagatatatactggtcaaattcatgtttgagaatgagcacatattcttagtcaaatgtttgctactattcacatgcaccagaaacagtgtcagaggagcctagttaaggtctaccttgttattgttgcatgacaatgcaggccagggaaggccatatcttgtcattattttaacagaaataataggatttttttgccacctattgttggcaataattttaaaaacacaacaaccacaacaatacaaaggcctactcgaggtctattcagtactagcctgaactgggtaagaaggttctgcaggatggaagtaaaatatgtaatataattttagtaggctaaaagagggttagtactcaatgtggtaagaacatgtagcatgtaggaaaaggggaaaacctcaaaaaggtgtcattttggctgaattttacagaattggttataaaacaattaaatctattaagtaatatgctgttacagaaaatggaattatataaattgcatgtagacaactttaaatttggatgctaatacaccagagaagcaccttgagtcgcaggagacagaacctaagtagtggattcaggtttgcttgtagtttcatatatttagagaaatgaaatagaattataaagacaactttagagcctatgtaatcctgcacttaattttcagttaacaatactgatacttaacattgatattgcaatacctacttattaggaactgttctagacaacttccctttattcaggctaatatcaaatcaaagtgcaggtctagaagccactgaccaaatctttgacctgggaaactcgagggcctctgccttgtgaaaaatggaacaaaaactcaaccggcttcagagggttgttgggagggaatggaagaagagtcatattttatttttcatgctgtaatacaactttgattctttggaatgaatgcaaccaaagccgaatgatattttcacctttgcttaagcatcagggttattgacaccgttaactaaaatggaagcgcagcctccagtataaaagaccaagggttctattctagccactttaagtacaagatgtccacttaaccaatcatagcctttttgagcaactgctgcctagattctcattcatcaaagtaaaatataccaaaaagcgagcagcattagttagggtaagcattagtaaaaacaagaatcactaagtaaaatactgccttaatgcaggctaaagaaatgttagtgtttttaaaaacagcaacatattttctttatccactgtatcattgatgggcatttgggttggttccaagtcttcgctatgtaaatagtgctgcaataaacatacgtgtgcatgtgtctttatagtaaaatgatttataatcctttgggtatatacccagtaataggattgctgggtcaaatggtatttctggttctagatccttgaggaatcaccacactgtcttccacaatatacaccatggaatactatgcagccataaaaaatcgagtttatgtgcttttcagggacatggatgaagctggaagccatcattctcagcaaactaacacaggaacagaaaacaaaacaccacattctcactcataaatgggagttgaacaacaagaacacatggacacagggagggaaacatcatcacacaccggggcctgttgggggttggggggtcagagggctgagagcattaggacaaatatctaatgcatgcagggcttaaaacctagatgatgggttgataggtgcagcaaaccaccatgggacatatatacctatgtaacaaacctgcacgttcagctcatgtatcccagaacttaaagcaaatttttttttaaaaagagcaacacaatatgcacttgtttatttctttgtttttgttttaacaatgctctttaaagttagtttaaaaataacagtagcctgctatttttaatgttaacattaacagaaaattaaagcttaaaggagatttaaagatcatttagttcaaatcccatattttagagatggacacttatccttcaggagagcaagtggcttgataaaggtgacacagatggctgatggaatgaatacatgagactacttttaaacacttagcaatgctgaggtgttttaagatttgatatgaagctttgttttgcaggaatacacaatgcaatttcccaaggtcagcttgagattctgtttccataaatttcataaataaatatggaacccataatgttgcagagtatggattacggccttccctcttcataaatttcatgatttttaatcacttattttatatagatgtgtatatataagcttatatatatgtatatatatcagtgttacatctatataatgttgattacacacaggcaaattacttaggtacaaaggcagcatttttcactcattaaatatttgtgagaaaatatttgagataaaggagaaaaaaatcaagtatttagagaggaatgtgtactgaacaagaaagtgtctctggcagataaatattttagccatggaaccgacagcatgtctaattcgtgaagcaaatattaatcaggctctgaccatgcatgcagctctgtgcttagcacatagtaagttttcaacagatgaaatgcaagatcacatagcaatggggaagagggactagaatgactcttcagtcccccaccactgagtataaattctgcaccccaccaattggcaagtgttcaagactttggaacttagagaggtaaagggagaagcaatgggaataggaggcagagaaggggtaaaaggaactagaggaaaaggcaaataagcccaagtgtgtttgtgctcacttcagaaagtcagagtcacagaaaagcattttttaaaatgcactaatattctgccttccctttatttaaaatatggaacattcatgtgtcctcaggcagagaaatcatttaaaatatgttggaacaaaaatgattaaattagctttattcttcaatcatataatttacaagagaatatcattcaaaagaaaatttctaaacttggctgatatgaagaattggtttcagttgtagagattataactaataagtgaaatggaaatgttcctaaatttttttcagccaagatatcatggtttttggaacatgtgttttccaagagtttttagaaagcttaatgatatctctgattgcaaagttttagcatttggcattctcattcagccaaaggctgtgcaaaactttatgtggctaaataactctccagaaaggatgcacctaagacacttaatggctgagtaaattcagatgtgctcatatagcaaaagcctactccaaaaaataaactcaggtgggactagggcaacattttcaaaataattgtcgtatttgtggtaagagagaaatattgaattgcattctcccctaacaaagcaatcaatagatttaaaacctccgtagttgtttctatccatgtagctaaaaaatacttcggttctgagattcacagactgtgaaacaagtggagggacaatcttgacttgagatgggaaaagaatactaactcagcccccattccaggtatcctttaaggaatccttctcattttaatcacattacttaaatgctactatctaatcatgtgactcataaaagtcacgattcaatgtcatgttttccctatactagatagttctgagtcttggttctgttatcatatatcatagttactgatcttctgggcaacctgttgtgagtggaacagagaatatatttgaagaatatttgactagaccctcctttcttgttgttacataaaaatggtttctccttaagtcacaaatctattctgcatgttaaatatttacaaagtactttaaaattcttcctgaatgctaatacaaagatagcaatctatgttcatttaaataagcagaaatgtttgccctcccaaattaagggcctctgagtttaattcaaatcaatttgatgacttgagagaaaaaaaaaaaggtggggacctactaagtacaagatcctgtgccagacatggagataaaataaactttccaggactagacaatccgtcagaaattactacatttcacattatttaattcacaccatttccttctgggcttaaaaggtaaattataagatgcaaaatactcacctttttagcattaagtttttacagtgctccttaacatccaacatttaactagttacataaagatgcagtgttttctatatattaacatattatttcacattttgttcattaggcttttgaaagtattttagtatgaaggttccatttattgtatccaaaaataaaaatagcatcaaagtctttttgcaactccccaaacacagttagtgaataatgatcgtatgctaaaaaatgtaaaatgcaatttgtgccgtgccccatttactacaaaatcactacgaacaatgcattttgtacagtatattgctccagggaaactggatcggcatcaggaatgaataaagaacactgcatttgaaatcagctaattctgcttcagcgcttttaaaaactatttgttatgatattacttcctgtcaagcacataatgtgatattttcctcaataaaactaaacagttgctataatttcagcttccctcattttccactttttaaacactaaatatttaaacaatgcagacctggaagtctctagccagtcatctgatccatgcatctccttgcctaaggtatagtaactatccatacgggggcctgttatgtcacactgacatacttagtggcagctgtcaaggtccttacctgcccacaggccaggcccattcctctttctcccatgccatgtggacatgataaatttaactccagggcatctgctccagaatcctttaaacaagaaaggaaaatgaaagaaaaggcaaagctttatttatataccaataggctttcaccgttgataacacaagtcacatttgtcaagtgttaactattctgttttctgcatcacagctatcttgtgaggtatagtctctctctctcaaattaaggtctatataacaaccaccaccacaacaacaatcacacaccaaatatttactcagtgctcataaggggccactcactgctctatatgttttatatttgttacctctaattctcataatctttgtattattatgctaccaagtttacaggcatgtgaactgaagcatagggaggttaaatgacaagcttagttattaggtgacacagtagagattgtaactcagatctgtttgacatcacatttattccttcctaaatagcttctatttttatggacacaaatcttactaattatggataactgatgctgggattaggcatacaaacaaaaatgtagtaggctagctagaatgaataagcaaaatgtaaaatgtttttaacagaaaatcaacattatcatacttaaaaacagtttgtctaagaaataggaagtattgatagttttgtcttaattacttaataggaatccttcttatttaaatcattaattccttgatatacaaatagatcttgtataaatgaacaacataattcattctaagtattcttggaatactttgagaatcttagaattcgtgggaagtcttctgtaaagaacatgaagaataaacaaaacacttttaaaagttattataggccgggcacagtggctcacgcctgtaatcccagcactttgggaggccaaggcaggcagatcatgaggtcaggagatcgagatcatcctggctaacacagtgaaactccgtctctactaaaaatacaaaaattagccgggcatggtggtgggcgcctgtagtcccagctactcaggaggctgaggcaggagaatggcgtgaacccaggaggcgcagcttgcagtaagctgagatcgcaccactgcactccagcctgggaaagagcaagactccgtctcagaaaaaaaaaaaaaaaaaaaaaaaaaaaaaaagttattatagtggccgggtgcagtggctcacaactgtaatcctagcacggtgggaggattgcctgagcttaggatttcaagaccagccaggcaacacagtgaaaccccatctctaccaaaatacaaaagattagctgggtgtggcggcctgtgcctgtaatcccagctacttgggaagctgaggcaggagaatcgcttgaacctgggaggcggaggtggcagtgagctgagaccatgccactgcactccagcctgggtgacacagcgagactccagttccaaaaaaaaaaaaaaaaaaagttattacagtaattttagagatggaggaataaactagctgattcaaattttatattcttttacctaacttctataatttttccagtgccgcggtttatttttcggtaaggccaactagaagcttgaattggttataagagtattttaacaggtttatcacatgcaaaggcttaaaaaatagttcactactttctaagtacaccagacctttctttagggcaacagttgtttcttctttctctttccttcctaattgtttaagattttagcctattttttcctgctttgtgaattttaagtaggacctcaacaaatttaagaactccagctagtcattaatcggttgatagtcttgcctatctttattcattagtgagtctgctttttcttctgcacatttgttaaagtccatttgatcattgagcctgtttttaacatggtttccttatggttttgctttcctaatccgattttaaaggtcttcatgttatttgagagttgctgaaaaccatgctgctctttccttgatggtttggtagtgagcatggatgagcacagcctgctgaaccctgagttctaatcttacgcctgtagctaaggaattggggatgatttggacaagtcagtcaatcttctttgtctccagctgctcaagtgtcaactgtggataatatgacctgtctcaaaaccatgtcatgcggtaattaccagcttagtgaaaagattgtatagtgcaagtatacacttataacatgtttcttattatttcctggttacttcaaatatttcctgtagacttctctatttaactgaaatgcagcaattaacagcaaatcaattcaacatcattttggattaaataaggctttgcataataattttatacatatttacattatgcatatttcatttcaaacttacacctagctaccatattacacaataatagcttacattaattgagcatttacaatatgccagatactttactatgtcctttgtatgttttatcttactttatcttcacagcaactctaagaggtaggatatatcatcatttctactttacaattgataaaactgagacataaagagttcaagtgatttatccaacatcccacagcttatagctgatagtagggtcttgaactcaagcattttgagtccaggacctgcatttatacccactattataatttactacaaatcacttattttatggctggagttgtcatagtgtgttacgaaaaacataacagctcaatatccttacagcttccaagcttgaagtaaaaattaaaatattttaaaatcacctgttcaatataaaattttttcactgactaattattataatttccccaacattatacacatatacaaatgcccactcaccaaacacacctggcaaggcctttgaaatgtgtatccaagcctcaaaaacagacaatgctgttcaaggtgacaccatgagaacaggaacattcatgtggcctctgcttgaaaattcctgtctcaggatgcacaccaccttaaaaggcagttaattccatttccaagcaactctaaccattcaaaaagccttaattgctgaattagcatgaaatgttaaattaactgaaattgggcatgcattctgattcttgttagtcacaagctttttagtttagtcacttacccagagtttattccacctcacctaaatggttataaaatgaaatatcctagtgatggcagtgacataggaaatacactgttactaatttcctacattatctatttatcatccatctatacacagtagaaagagagagtttgtgtgtgtgtgtgtgtgtgtgtatatatatatatatggtgtggactctgagccaaactataggtttgaatcccacttttactccatcctagctgtgtgaacttgaacacactctttcactacttttggccttagtttcctcaaaaaaagaaaaaaaaaaggaaaacatcaagtcagagaagctagaactccaaaaaatattaaaaattaaaaataaaaatatatttaaaaagtggaactaagtcacagagttgttgttgtaaggcataaataaatttgatatttgcacagaagagttctagggagatgtatttttaaatgtttccaaggctaacacaggaaatgaaaggtgccaaaaaagaaagtttattttttacagttttaagtaaacagaaaagaaaaataagagctttaacatatataagagtttaaagaggagtgataaaaaataaaagtaaatgacttctggaatgtagtaaatactataaaggtgtatactatctatctaaatactttatctatctacctatcaatcatctatctatctaaatacttatctatccatccaaatagacctctgacttgtccttcctctgccttgatatgaaaatgatttaagataactcacctggtcctacattgtctatacctcaggagggaaaggaaaactatcctgagaaattcttggaatatgacagtggtatagtttttaaaattctctgaaccactttataaaaacacccagagaaactaaggtggcaaaaccacaaactcttgtgcaacatatacaatgaaatcatgcacaaagcatttctcctctcttctccttctttccttacctcttcctttctttcccttaccttcctgatcaatacagctctaaagtcactggtcaggcagggcaagacaggtgagcacgagcatttgaggagccatgagggcccagtgtgggatgtcacagcctaagcggagcagagccagaaggatgtctacatggccagtggcatggtgtggtatatcacggtccaagtgggaagggaagacgtccgtgggtgataaggtctggcaaaggacatcagagctcaagtagggtgagaacagtgtactgtactggggcatgaaaggcacagttattggattccctcttaacttcttctgttaaatgaatacatggggtcagatgttgactttccaagtagcaatgctatcctctagtctcaactattcaaaactggagttaaagttctctgggatcttaaacctctctgagatagacctgggacaggtaaaacactcttggcttgggccccactggatgtaaagtcagttactatctctcatctccagctgcgtgtctatctcctgtgattccattctgtcctgttactgtccctgttcagagacttaacatccaactggtcctacatatctctgtaatgtgcctctgtttgatttttacctcaaactatttgggatttctaactctcacagctatttaattcatgacatattgctgtccagattcaggtaaagaaactgataggaaactggcttgttagtgttttagtgttttattttggccccgccaggaatagtgtggtcacttggttttaatgcctatgcctttctgctggaccttccttgtctcttcctaccaaaggtggtcagaaccttggcaatctctcatcaggtacctgacttaaaatcatcatcactggattttaaacacttcaagttcatgggtgccaaataaaataccattcttcccatttattctgtaatggcttcctttttgtttgtcacatggcaatactcgaactgtatacttcttttttacttcattcaacaaatatctgctggtaaagaaagccttgtgcttggaattgaggattaagcagtgaaccatgcaagggtctcgacccccacggaacttgctttctaacaagcaggacagaggaactattagtagtggccaatgacacaactgttaatcaccactttattatatgctacagaggaaaaacacagacagaggtagatccagattttggggagcctaatgcttaaataatttggaaaaccctctttaaggaaaaaacaataatcaaacattgtaaacacagagttaggtacagggacttgcaagtggcccatgcaagtaaatgccctgaagcttaagcttcattaactatctggtcaactggcctctgaagacagggtcttacagaataggacagggaggtttaaactacgtagccagaggctcaggactgaggaagagagaacattgcaggccaagggaacaggaaaagctctgagttgggaacgtgttggaggaggaaaagaaggcagcgggatctggaatgcagaaaacagacccacagtgacaatggggagaggcaggcagggcaggggccaagtagcacttaatggtcaagttaagggttctgaaattaggaaagatggaaagaatttggattggttgagagcaagaagattagtggagctattgtagttaaacttggtaatgatgcattttggaccacagccaattatacgcttcctcaaatttgatggccctacttgtcacccaggaattttgccactagttaaaggggagccccagtcccttttgctatcttcacatctcctatagtaactgtccgctctcacagactccctccagatgagagtgggttgtgtcacaacctccactgagcctgtcaaagtgagagctccaggagcaccagtgcccaggccccatcaggaggctctggccttcccctacaattctgggtttagaagaagcatcacaccccatgctagcaaatctagcttccctagcagctgccctgaaggggcaggacatgcaactcaaaagttcagaggaaaggagagccctacggagtgaaatggggccagtgagagacaggagactgaaggagccagtagactcattccttccacttcctttcctagaaagtgatgagagaatgggtgattctatcatcttgtgaaatgatgtgctattccctgtcccatatgactgagcaattggctccatttccttgtgaagttgtggccagctctggaatgcaccatattgcacttgttttcccttcttcccatctcatttttcttttctcctcagtctttctgctctgagattgtatacttcaataaagctttttcacattaacttttactcgggctctattttcaaggctgattacaaattacaaaagaaattgattcaagatcgactacactggattaaagatccatttacaagtgaatattgtgaaccttcagaaatggctcagtttggcatatatctgattgctccctattactcatctttgttttggctagccagggactttatacatagtaggtgtttcataaatcttcttttgcatagaattggagtagactaccaaggttccagaaaagcaagagagcctgtgatcaggtacctggatcaagaaaactaactagattctaacaatgctactaatttgacacaagcagtagaaacttctttgtggtgctcaaaaacatgacaaattcaaaccaggttgaagaatatagaacatgaaatgcatgtgcattctaaggctctactgctccatatgtgtcatttctgtttcagatgaagtagtaaaaagctgatagcaggtttcctcagctctccattgtgtaattcaagaattaatctgccataaagacagttttataaacttaaggtttagtatacatcatcatcacatcacagcattagctaaacttgaaacagttggcatgctagagtgttggtgtggtgtctctgatttcttacatccctatatcaccaccccaaaagaaatgtatatgttaggtagtacagtaattttgacttgaatatgtttttgttggtttgttttaacgtgggtttttccattgtaaggaaatctgttttaaccggttttgaagcatattcataaaaccaaaaccaaatactgattctacaaaacgttattgggtgcctaccatatgagctgtgatgaaatcatgctgcttaatgctaccctcctagaagctgtgaaggcctgcgggatacttccttcatatgatatctcctgggctagtccagacttaagattatagtgaatatttttattttttaattgacattatcataacctcttgttatgtagactgctctcctatggagagattttgcagactgttttgattgaacaaaaggcataccttttcctcccttctttcttttttttctttcttcctttctttttatttatgtttttgctacagagtaattagaaggtgatattaaataaaactgaaattaaagaaaaatatgaaatgtgaaaaatatctttaggttagctagtttgcttataattaaaggcttttgacttataaaaagtaatgttgtctatttaaaaattaatgtctaatattgaaaaaaataattttgaaaagtattttgttcttacagaaaggcagagaagcaagcggcatgataaagccattcatcatagtcagcttaaaattggcaaagctcatgccaagcatgggctctgtggaagatttcatggtcaattaggtaaatacatgtatcaaatgaacccagcatggaagatcacgaggccaattactgatcatgtttaatttcacccctctaagtcccagtagtaatttttcccttctcagttttaaaatatccaaataaaatgtataatcaacatttttgaacactacagacagctttgcaatattttataatgtagcgtcaattagttcattggtatagttagatttagtcttctacattactgagaggttttcaaggaaccccagctaagactctccagactattttccatgacagcatgatggacataagtgtataattttaagtatgtatttttctatttgaaatacaaatttaaggcacatggttacttgtttgcatttgtgcaggattcaatttatattatggaaaacctgctgactagtgttccattcaggagcattctgtcccgctcttttatgcatgtctgtattcaaactagaatagtattaaatgaaccttttatactttaaatattcaagagttttatattcaaaatttcttctcttactgtcaaactagtttgcctaaaggcaaggtaagatcaagttagactctcaaaggtagaattaaattttatcatggcatccatcataatatacagtttgcttaacatgcaaataaagagtgtatggattcagagaataaaggatttttaggtagtgtgtgaaatccaagggaccgcttttatagaataaattccttttaaatttacatttccatcattttaatgaaaacacagggtaaacaaattataatagaaatgttttaagttacattttcaattcagttttacttctactgtattatttctcatggcagctctttatttaaaactaataaaaataggagagaagaaataaaataaatatatactaaagtaaccattacctcagacttcttggcaagttccgtccagtcatttttattgtaactgcacataatgctagcaatcacaatctttaaaaagaaaaacaaaagaatataagttcaagtagttatccagttgtacacaaagatatattaatatttacataaatttataatggtaaactatattataaaattagttttcaaactgtgaaaaaataaatcattagaaaatagcagggtaagatagcaaaacactggatgacatttggggctttggaattacattaggagattttctcatttactatctgtgaacacttgggcaagttacttaacttttctgatcctcagcattctctttttcaaaatagagaggattttactggctttgccatcctctgaaagtagcaatgtaaatacatgcatgtacgtgaagggattgtctaattatacaatgccattaaaatgctgtttgtaattactggtacagtgaaaaggttttaagtgatggaaaagaaaaaaaatagtgtctctttcaaacataactcactatagtacacataataatatcttaaatattcatagtgcattatagttttaaattttattatgtattgattatttaactacattattacagaaatcccataatggagactgtatagagtagtaattaccaatgcctcctctgaaactaggatgtccaggttagaaccctgactctgtcacttacttgtggccctgagcaaagtatttagtttcctgattggtaaaatatgaataatcgtgccacttattaagaaaagtaataacagaaattggccaggcgtggtggctcacgcttgtaatcccaatactttgggaggcagaggcgggtggatcacttgaggtcaggagttcgagaccaacctggccaacattgtaaaaccccatctctactaaaaatacaaaaattagccaggtgtggtggcgtgtgcctgtaattccagctactcgggaggcagagacaggagaattgcttgaaccaggaggtggaagttgcagtgagccaagattgcaccactgcactccagcctgggcaacagagcgagactctgtctcaaaaaaaaaaaaagaaaaaaagaaaaaaagaaaagaaaagtaataaaagaaattgctaagacttacatagctcttacagtgtgcttggcactgtttcaatggtttttactttattaacttatttaatcattcccaatgttattctccccactttatagatgaagacgccaaggcaatgacacctgacagtcatatagctgataaggaacagcgccaggacccagagccaggcagtgtgactgagcaagagtctgtgcttttaacgactaggttttgctagcccaaagcacatacttgatacacgtaagtaattatttcctaccattatcatttaaagactatgagattgaggctgggtgcagtagctcacgcctgtaatcccagcactttgggaggccaaagcaggaagatcgcttgagcccagaaattcatgaccaacctgggaaacagagcaataccttgcctccacaaaaaaatagaaaaattagctgggtgtggtgccctgcccctgtagtcccagccactcaggaagctgagatgggaggatcacttgaatccaggtgttcaaggttacagggaggtatgattgcattactgcactccggcctgggcaacagagcgagattctatctccataaaataaaaaaataaagactaagagattgagacacaaagagtttgtgccaagcttaaagttgcagagtctagtggtaagagtcctctaaaagccactgtgctctcactacatagagcttttttatttactttgagaaaaaaaaaaaaaaagatatgctgtaaaagtcagataaacgttttcatcaggagaatagaaagttgtgaccatattggagagagttctaaaaaccagggaaagaagcatgtctttaaagttttttttttctttttctttctggatagactataaacaccatgaaagctggagctgctctgcattagtcatcatctatctacagtaactagcatggtatttggcacgtatcaaagactgaaagaataaatgaatgaggtcaccagaggtttaggagcaaggggttgcattatcagctaacccttttaagaagattaagtagaaatggataccataagttagagaagtgaaaaataaacaattgaaaactgctggcgattatatgagtaagagtgaagagtgattagggctgatgaaggtatctgtcttggtgatgaaaaaataatcagatattaaaatacacaggactagtcaactagagaagcaattaaaaagaaggaagcaaaagatctgagactctgaatcaaagccactgagaaattcgcagaccattagtcacaaaaaggttgaacaacgttccgaaatatggaagccagaagaaacagcaattttgaatagattccttagagagaggaacaaagagaagaaagtaaaagtagatgatggatagagaaggaaaattaagcatgccaaattattgttcattgagtttaggattcaatttttttcgtctagtgaaactacagcttttcagaattggggagaaaaatgtaagaatgcttgttccatggccttttccctaggggctaaaaaagtgagaagtcatactccaagcttcatttgcaagtataaaaggggcaccatgtaattacacagcttcagttagagatgctttccgccctttccaagtgatctaagagctcagggatgctatgccctattctccagttagaaaaaagatcagggagaactatcaaagagggcaccagatcttccaggactagacctaatacctcttggtgtaggcattccttgcaaaaaaaaaaaaaaaaaaaaaaaaaaaaaaaaaaaaaagagagagagagattaaggaccttatttgaaaggaaaaatcaactggggaatgggcagagccctgaggcttattgctagaacttcaagggcagagacagatacagagatacagactgaagaagaagaaaaaattagctattagatactagttaccctgtggcgaaactgataagcaatatgcatagatttttagaaaatttttttcttaaaaaaaaaaaaacaaaataaaacaataacaacaacaaccacaaaacccccacctcctaacataacaaaataatcccccaattcacattctcatgcaactatgaagtggctgctcaatcagcacagtcacagcatgtgcacctccctctccagctcccctctcagggttccacagaggacaagaaaaacctttctcgtgggctgaatctagccaggcagatgggttgaccacagaaatccacagcagggaagcaaggtttagcagccttgacagtaggataagatatatcctctcaagtagggactaacactgtttctctcttttacatggcaattttaattttaacagagctatttttgcttcaaatttatattgactgtgccaggttggttaattgttcaccctgtaggttgctgagaagcatgaggcactacaattggacttgatgaagggaaataaatatcatacagagagttgttcaggacattgcgagaatcatgccactgaatgctggtggggcagcctctgactggggaggggtgaccacagatgggagagatacattatggtaagcagtggtttccattgtatgctctgagcagccaagcactaccctgttctcctttccctatccattgaaagcagactctatcttcttgcccagaaagatgagaaagtatccccacctgcactgatcataggaattaggtactctgcttctatcaaaatccctcagtggaactgggaaagttaaaacttttttttttttctccttggtcactaaactggaatgaagtttattcagagctgctgttgatcactgattcctcatttaaccactttccaatcccaaagcttactacactgggaaaaaataaaacagagacaggagaaagtagacaaacacacaggatggagagagatcccctttgcagccacttttaaggctgggtgcctcactaacatatctgcatatttaaactaataaataccacactttggcttaaggaaattctatttttacattcttgtttctatgatttaacagtcttgacaattactacatgcaaaactaaagttgtcatgttttgaagaaattttcaaagcaattttttaaatcaattaaatttcaggaaaaatgactttatatttattttaaaaatgtgaaatggtctaaggattctaaatatccttatctaaagccagaggatggtttgtgaaaatatgtggtagcattctatttctgagaaataaagatgaccaaaaaataattttactttttattaaaagagaaagcaatttttaaaagagtcaggctaaaagacattaacagtaaaaggacactggacataatttaatatttatttgataattaggaagcccttcagtattttgctgtactccgtttttaatcaagcaggagggaacagattttttttcctaagaaaaaaaaccagaatgatggatattttatatcgtgaaacatcatgcaatgttattagaaataaatacccaatgaaatatatttttaaataaaagcaacatttttctatatcaatatttcacttaatttatgccatttctagtgctcaatttttatggctcatattttaaaacattattgaatgaagagatagtgaaacccagatgctacacagtatttgaactttgtcttcccccatcctacagtttatgttacacagtctggtgggagattcaatgtcacctaattgattaataagcaaattgagcatctaatataagaggaattaaatggcacacaaaaaggagcttgagacattgacttagcattttcgtgtattcaacttctaaccaatatttcttgagctccactatatgccaacagctgttctaactcagaagtgatgaacaagacagaaaaagtccctgccctcctgaagcttacattttagggaggaaaatgtcataatgagttaaaaaaagatactttaattggaccatttccagttccaattgttagacctatttataatattatttttaggaaggtagtaatagaggaggagagcatgacagagaatcaccagaatacataaatgcatgtcagacacatggtcagtaaaaagctccctgagttgaaaactgagagatgagatggcacctcacattaaataaaatgtggaagtgagtaaaagcagccaggtatgtagaagtaactgcaggtgcaaagactgaggtgggaatgagcatggtatgttcaaggggaaaaaagaaggcttttgtggttgtagattcatgagaggacaggaatagtatgaaagaaaatgagagaagcaggcaatagccagatctctgggagctctgaaccctgtgggagattgggttttattgttggtgtaatgggaggccgcagaaaggtttaaaggagggtgataaaataatctgatgtacattttcaaaagatgcttgtgactatagggaataggataagtgggttaagggtgaaagcaaggagtctgattatgttgaaataatgtggctttcataatatccacggagatacagagaagtggatagttctgaggttctagttggtgaatgcttagattcagagagacatagagaaaagtagaaattaagaatgatcctagatatttggcttgaactactgaactgtggaatgtagacaatttactgagatagaataaagcctaatgaagaaagtattgaagaggtccaattttaatattttatatttagtatgtctagtaagcatagcattagtgaagacatcaattgtgccactggatatatgagtggagaattcactaaagaggtcaaggataaaggtgcaagttttagagacttcaaaataaaatggtatttgaagtcaccaggctagatgacttcacaaaaggaagaaaataatatagagaaaaagaaaggccctaggactgacctgggggcacaagagagtgtgatgtcgtgccaagagaaggaagtgttccaaaaagtaaggaacaatcaaccgtgatgaatgcttctgaaagtctgtgtcaaagagtagaaacgtgtccactggatttgaagagacaaaaaccattcgtaacctttaaaacaggggtttcagggaagtgacaggacaaaagtcaggctagaatgaattgagtgaatagaatatgaagaagtagaggcaatacatgaatctctctaaaggttttcttgggctagctaaaagacaaatgaaggcagcctgtacaagatcacgggaggactaatgatgttttcttaatggactatatttgagtatgtttttacactagtgaaaatgatttgggaaagagaaagaagctcttgagaagggaagaggggatgatgaatcgagagtacaagtggagaaagtgggctttaagagaggcagaggcattgtttgtatctaacaggatagaagacgagtagagagagaaacaaataagtatggatgcatttaggtttctaaattcgatgtggaaaaagtaaaatcattcttcttggtgtctacattttctttatgaactagggtgtaaggtctcttactgagagtaaagagaactagttatgggtttgtgactatgaggaagagataaaatgtgaaatagtctctaaaaatgggccaagcatggtggctcatatgcctgtaatcccagctactcaggaggctgaggcaggagaatggcttgagcccaggagttttgaggcttcagtgagccatgattgtacctctgcactacagcctgggcgacagaatgagattttgtctttgaaaaaaaaaaaaaacgaagaaagaaaagaaagggaaagcaaatttactagaacatggtatgattatgaggtcaaaaaggcagatatttaatcagtgttgataatatttatgaaaaatatgattagtaaaaatcaaaggacaagttgatttacaaagttggaacacagattacagtcccctttatattactgaaaacatgaaattgggttttatagattgtcttagagttgagacccatcttatcaagatgctttttagtgcttaagtcattaaaatttgatatgctcctgaaaagccattcttttagtgaattctgcttcgtagaaaatacttttaaattggagtatttaatagttttgactttcattttgactaattaatacaacttaagaaaatgtatacactttttgtaaacatctaatttctatgagacattaacattttgaagcatataaaatgcaaagtatgataatttactaatcaaattttgcatatttctttctctctaaaaggtatctcaaaggtgaaaaacaatgtgcagatgcttatttggcaaaaaaaaaaaaagtagtgctatatggcttccattgtcatcctttgaaattttaaataaaagaatcaaatttaatggtcaactttttttgttttgacaattccatttccttagggaataaataaaattattttattaagtagcttttaaaaactgaatttcattaaagtttacacattaaaaattaaggtgaagaacaacataaaacttgcaatggcttacaataacatgcaggctgtcttgtcaaattcccattgacttcaggtctatgctttttaaaacacattgacaatgctattttggtattctgtaaccatactgtgaactacataggaaatccagtcaacaattcagcttcaagacaatctaaattttttagtagggaaaaactgcaaagtgacgggggtgaacaactataaattacaagcagccaagttaggttttgtcaaacaattcaacaaaatcattcctaagactactgggattacattgatgaggaaaaacagcatgagacatttgattttcaaagacatttaaacaaagaaaataagtttattaaatgttaattaaccatacaacattcaaattttagatgtcctttatgccttagttcaaatttagtgaaagtgagattggtgcaatattcctgaaatatatacattgactataagacatttaaggtgaaataataagcttttctaattttatttgttcattgcttacttaatggtcataaatgagactagtatgcttacaagttgtcttttaaaattatttaaaaattcatcattttttggtttattttggggctgacaaatgtcttatttacacaactatttcaaatatagaaaagtaacatttaaacaatatacaagagtttctataaaaaatcagagatgttttccaacacaacaggaaacaaccactgtaccactctaggagctacagtaacttgctttttcctccccttttgatcactccataatatatttttatttagtttctgtccccaatatgcttaggaactgatctccccaaggttaacagtgacctcaccaaatatattatatacttttcagcccagatctgtactaaactctcttcagcatttaagactactaaccacctccagtttcttgaacccctcttctaactgagctttggagataccacttacttttcctctttttttttttttttttggtgttctttttctacctctgtcaatttctcacatgttgatgctcccagagtccactcacagtcctcttttagtctcatttcacatgcattcactagacatcatattcgcaatgactgtaaataatatctattaatacatgcagaaaatctcgaaagtgtatacctctaaactgcatctttttcctaagtgcaagaattgcatatacgactacccgttagcacttaatttccatttgtccaaaaccaaacttaaatttctccactctaaatttgcttatttatccacactatatatgcttttgtttcactcttttgtcccagatcagaaaactaggaatacctatctttgtcgcccacatccagtgattaaccaagtacttggctgagcattgaaattacctagagagttaaaaaataataataattccaaggattctgtgttaccttgtatggagtgaggtgcaggcatcagagtttttcaagtctctctaggtggtcctaaagtacagggaagtttgagaagtactgctctagtttattttccaaatatctccaggttcctcattgtgactacattaagatcctcaccatttcttccctggattactgcagaagattccttattagttgccccatatctgatttcagccaatactatctgccaaagtattctaaagagacaaacctcctcatatcacactttggcttcaaatccaatttcaggataaaataataggctatacaagaccatagtgcaacttttgctttgaccacactgaattgctttgctttctgagtgtaatttgcatgctgaattctcttgatcatatgtctgtttcttttgtctaaatgtataaggaatggtcaaagcacatggcataataaaggaaacatgaaaattgatacaaaaaaaataatactaactaagataaaatgagagcaaaagaaagggtaatcatttgtaactgtgtgaatcagggaaggcaccatacaacaggaacacttggccaattatgaaatcacccatggacatttagaggtatacctcgaagatattgcaggtttgattccagatgacagcactaaaactaatatcacaataaagcaagtcacacaaatattttggtttcccagtgcataaaagttatgttttcactacaatcaactgagcctttggtgaatcataatctttttgctaaaggaatgtcttgtcttgatggtgatagctgctgattgatcaggctggttattactgaaagctgtagcattttctttctcactcttttttttccttcttttttttttctagatagggtcttgctccgtcacctatgctggagggcagtggtgggattatagcttaccgtggcatcgaattcctgggtgctgtagcaatttcttaaaataagacaataaagtttgctagattgattgactcctcctttcacaagagatttctctgtagcatgtgatgctgtttcatagcattttatccacagtagaacttctttcaatcctcttaaatctctaaaactcagttactgctttatcaaataggtttatggaatattctaaatcttttgtttttatttcaacaacgttcacagcatcttcaccaggagtagatttcatctcaagcaaccactttctttgctcattcataagaagtaactcctcatctcttcaagttttatcatgagattgcaggaattcagtcacatccttaggctccacttctcattattgttctcttgctatttctctaatctgtagtgacttcctccactgaagtcttgaatccctcacaaggcttgcaatcaatttcttccaaactcctgttaatgcagacatctgacttcctctcatgattcacaaatgttcttaagggcatctagaatggtttgatattctatccagaccactaaaatgttatccagaccactaaaatgttctccataccagcaataaggctgttttctttcttatcatttgtgtgttcactggagtaacatttctaatttccttcaaaaactcttcctttgcattcacactttagctaactatttggaacaagaggtctagtttttgccctatctcagctttcaacatgtctttctcactaatcttaatcatttctagctttggattaaagtgagagacatgcaactcttcctttcacttgaacacttagaggccattgttgagttgttaaatagcctattttcttttttttttaaattattatactttaagttctagggtacatgttcacaacgttcaggtttgttacatatgtatacatgtgccatgttggtgtgctgcacccattaactcgtcatttacattaggtatatctcctaatgctatccctccccactccccccaccccacaacaggccccggtgtgtgatgttccctaccttgtgtccaagtgttctcattgttcagttcccacctatgagtgagaacatgcggtgtttggttttctgtccttgggatagtttgctcagaatgatggtttccagcttcatccatgtccctacaaaggacatggactcatccttttttatggctgcatagtattccatggtgtatatgttccacattttcttaatccagtctatcattgatggacatttgggttggttccaagtctgctattgtgaatagtgccacaataaacatatgtgtgtatgtgtctttatagcagcatgatttataatcctttgggtatatactcagtaatgggatcactgggtcaaatggtatttctagttctagatccttgaggaactgccacactgtcttccacaatggttgaattagtttacagtcccaccaacagtgtaaaagtgttcctatttctccatatcctctccagcacctgttgtttcctgactttttaatgatggccattctaactggtgtgagatggtatctcattgtggttttgatttgcatttctctgatggctggtgacgatgagcatcttttcatgtgtcttttggctgcataaatgtcttcttttgagaagtgtctgttcatatccttcacccactttttgatggggttgtttgattttttcttgtaaatttgtttaagttctttgtagattctggatattagccctttgtcagatgagcagattgtaaaaattttctcccattctgtaggttgcctgttcactctgacggtagtttcttttgctgtgcagaagctctttagtttaattagatcccgtttgtcaattttggtttttgttgccattgcttttcgtgttttagtcatgaagtactttaaatagcctaatttcaatattgtcgcatctcagggaacagggaggcctgaagagactgacggaatgagggatttgcccatgagtgtagcagtcagaacacacacagtatttatcaattaagttttccatattcaacgggtgttcgtggcacctgaaagcacttaacaataatatcaaagatcactaatcacagatcaccataacaggtgtagcaataatgaagaagtttgaaatattgcaagaattaccaaaatatgaacacagaaacatgaagtgagtgtatgctgtttgaaaagtggcaccaatagacttgttagaagcaggattgccacaaaccttcaatttgtaaaaaaagcaatattgcaataaaatgaggtatgtctgtattggaaattgatttcaaaatccaaggaggtagagtactccaggtagagtgagcagcaagatcaaaagcaaaggatggtgtatttaaggaatatgctgtgtttaagaaatctcaggtagttcaatttggctgactttgaaacaaatggttacgtttcataaaaaatgaagcaagatatctaagtaggaatctggtttatgcaggtaagggacaaaacaatggtttctaatcagctaagcatttggatttgaattttcgatcattttctctagtaaattcgtgcttctcatgtagacattgccttctgggatgcctctcctgtgccctattgctcctctgacttcctttggcacccctcttctgagattcctcagtatcctttgcatttttctgctatgacatgtatttgtttatatattttatatatttttaaattatatattttaatatatattgtgcctttctacattctagagacagaataaggacacatagatggtaaaggtaaggggttctagatccttttataatttataaagtacattttatatcaaaaataatttttcattatatttgtttctgtatttacagtttagtacagattttcacatacattatctcatttatcccccacaacaatcttgaatttggagaatcttatactgataataatgaggcatggataatttaaattactttaccagggtcaagttaatcaatagcaaaggcagggattaagctcaggtcttttgattccaagttcctctctactacatcaagactataccatattgatttcctatcctttcaatttacattagagattctagttgattttatgtcttcaaccctctcgtggtagattgtttgaaaaaattgttccctcctggtttccatgccacttcggaaggactcccatcaagtgggggcatttatctacccaacctttgggtgtgcgctgattttgtgacttgttttaatcagtagaacatggtagaggtgatgatgtaccagagttaaaccaaggcttgaaggggcctggtgcttttctgcttactctcttgaaatcctaccaagacgacaagccagcataggttcctgaaggatgacagaccacatgacacacagacaagccatccagctgaggctgacctagattagccagtccctagcccacctggaacttgaccacagatggcataagaccaagtgaggccagaagaaccatgcagcatagcccagttaagcaaattgctaacatcctgaatcaagaactaaattaataattgtttcaatcccaaatttgaggtattttgttatataggaaaagctaactgatgccacttttactaagtaccacaataagaactattacatgctgtgtacttgcatatgctgagtactatgtttagaatttcacatgacttatctctaatccttagaacatcatagcatagaagttattagccccactttacagacaggaaaaaaaaaacttcaagaagttaaataactactcacagttgcatggctaataagagtagatacaaagcttgatctgtttgactataatatttatactttgaatgatttttttgtgctccttatacaacctttatagaaaatgtgttggtttacttttatagatggttaattttattcaatgtgtgtcagttttttattatattcattctcagaggctaaccttatttatatgatcttcgccagtgagttatttcactacagctctgcataccatctaagctagaccagcagatggaactgcctaagaaataataaaattagaggaaagaatgagtgagcaggaaccaatgggatgattcacagcttcctgaccattactgcatgttaagggctgatgatagggtagtattggccctttataatctggctccaaatcaccttgctgctccttatcttgacatatcaaactgaacctcttatatatactgcctaccgcatgccacatgtacttttagatgtccattcttttcctcatattggtccttcttgtagtgccatcctagacgtctgactgtacagctcctacctacttctcaaggtctaactcagagctaacctcaactgtatcatcctcaatgatctcagagacagaatcactgctttctcttaatattcaagtgtgctacaccaaccactactcagttcctgttggactgtgtcagatagatgtttatttatatacttctcttctcttgtcccacttctcttacctcactcaatgtgagaacatgctaattattatccacctttagtttcttatcatttggtgcaggattgcctagcacctaatgtaatttagtaaatgttggtggaaagaaagatggcttattattaataaattttttaaaccttccgtttcatccctatgaagattgtaatacttgctacaagcaaaagtgcatgcaggaaactaccatgactaatatatacgcatgtataaaagatcatgactactactgtgtagactgtagtagttatgtagtcatgtagtagtagtagcagctgtcacatatgtatgacagatatatatatggtatgtcttatatgtatatgaacctatattgacacagcatcatcatacaaatccacagtttacatcagagttcactcttgctgttacacattctatgggtttggacaatgtataatgacacgtatccattgttttagtatcatacagagtattttcactttcctaaaaattttctgtgctccacctattcattcttcctcaccccacccaaccctcctgcctatcactgatttctttactgtcaccatagttttgtcttttccagaatgtcatataattggaatcacacagtatatagctttttcattatggcttctttcagttagtaacatgcattcaagcttcctccatgttttcatggcttgatatttataccattttagcactaaataatatatcactgtctgtatgtaccaaagtttataattcacctactgaaggatattttggttacttcccagtttgggcaattatgaataaagctgctgtaaacatccatgtgcaggtttttgtggaaatataagttttcaactcctttgggttaataccaaggagtagagttgttggatcctatggtaagagtatttgtagttttacaagaaactgccacatgctgtctttttttttttaaattatactttaagttttaggatacatgtgcacaatgtgcaggtttgttacatatgtatacatgtgtccatgttggtgtgttgcacccattaaatcatcatttacattaggtatatctcctaatgctattcctccccactcccccaaccccacaacaggccccggtgtgtgatgttccacaccctgtgtccaagtgttctcattgttcaattcccacctatgagtgagaacatgcggtgtttggatttctgtccttgcgatagtgtgctgagaatgatggtttccagcttcatccatgtccctaaaaatgacaggaactcattattttttatggctgcatagtattgcatggtgtatatgttccatattttcttaatccagtctatcattgttggacatttgggttggttccaagtctttgctattgtgaatagtgccacattaaacatatgtgtgcatgtgtctttatagcagcatgatttatagtcctttgggtatatactcagtaatgggatcactaggtcaaatggtatttctagttctagatccctgaggaatcaccacactgacttcacaatggttgaactagtttacagtcccaccaacagtgtaatagtgttcctgtttctccacatcctctccagcacctgttgtttcctgactttttaatgatggccattctaactggtgtgagatggtatctcattgtggttttgatttgcatttctctgatggccagtgatgatgagcattttttcatttgtctgatggctgcataaatgtcttcttttgagaagtgtctattcatttgctgtgccctctttttgatggggttgtttgtatttttcttgtgaatttgtttgagttctttgtagattctggatattagccctttgtcagatgagtagattgcaaaacttttctcccattctgtaggttgcctgttcactctgatggtagtttcttttgctgtgcagaagctctttagtttaattagatcccatttgtcaattttgtcttttgttgccattgcttttggtgttttagacatgaagtccttgtccatgcctatgtcctgaatggtattgcctaggtttttgtctagggtttttatggttttaggtctaacatgtaagtctttaatcggtcttgaattaatttttgtataaggtgtaaggaaggggtccagtttcagctttctacatatggctagccagttttcccagcaccatgtattaaatagggaatcctttccccattgcttgtttttgtcaggtttgtcaaagatcagatagttgtagatgtgtggcattatttctgagggctctgttctgttccattggtctatatctcttttgtggtaccagtaccatgttgttttggttactgtagcctagtagtatagtttgaagtcaggtagcatgatgcctccagcttcgttcttttggcttaggattgacttggcaatgtgggctcttttttggttccatatgaactttaaagtagtttttttccaattctgtgaagaaagtcattggtagcttgatggggatggcattgaatctataaattaccttgggcagtatggccattttcacgatatttattcttcctgtccatgagcatggaatgttcttccatttgtttgtatcctcttttattatgttgagcagtggtttgtagttctccttgaagaggtccttcacatcccttgtaagttggattcctaggtattttattctctttgaagcaattgtgaatgggagttcactcatgatttggctctctgtttgtctgttattggtgtttaagaatgcttgtgatttttgtacattgattttgtatcctgagactttgttgaagttgcttatcagcttaaggagattttgggctgagatgatggcattttctagatacacgatcatgtcatctgcaaacaaggacaatttgacttactcttttcctaattgaataccctttatttccttctcctgcctaattgccctggccagaacttccagcactatgttgaataggagtggtgagagagggcatccctgtcttgtgccagttttcaaagggaatgcttccagtttttgcccattcagtatgatattggctgtgggtttttcataagtagctcttattattttgagatatatcccatcaatacctaatttattgagagtttttagcatgaagggctgttgaattttgtcaaaggccttttctgcatctattgagataatcatgtggtttttgtcattggttctgtttatatgctggattacgtttattcatttgcgtatgttgaaccagccttgcatcccagggatgaagctcacttgatcatggtggataagctttttgatgtgttgctggattcagtttgccagtattttattgaggatttttgcatcgatgttcatcacggatattggtctaaaattatctttttctgttgtgtctctgccagactttggtatcaggatgatgctggcctcattaaatgagttagggaggattccctttttttctgttgattggaatagtttcagaaggaatagtaccagctccttcttgcacctctggtagaattcagctgcgaatccgtctggtcctggactttttttggttggtaagctattaattattgcctcaatttcagagcctgttaatggtctattcagagattcaacttcttcctggtttagtcttgggagggtgtatgtgatgaggaatttatccatttcttctagattttctagtttatttgtgtagaggtgtttatagtattctctgatggtagtttgtatttctgtgggatgggtggtgatacccctttatcattttgtattgtgtctatttgattcttctctcttttcttctttattagtcttgctagtgctctatcaattttgttgagatcacatgctgtcttctaacgtgatcaaatcattttgcattcccaccagcaacgaatgagagctcctttgctccagatcctcatcagaatttggtgttgtcagtgttatgaattttggctattctaatagatgtgtagtggtacctcattgttgttttaatttgcatttccctcctgacatgatgtagagtaccttttcatatgcttatctgctatctgtttatcttctttgatgaggtgtccgttaaagtctttagctcattttttaaaatctggttcgttgttttcttattgttgagttttaagtgttctttgtgtattttggataaccgtactttctccaatgcatcttttacaaatattttctcccagtcggtggcttgtcttctcattctcttgacattatctttcactgagcggaagtttttttttgtttgtttgtttgtttgagacggagtcttgctctgtctcccaggatggagtgcagtggcacaatctctgctcactgcaacctccgcctcccagattcaagcgattctcctgtctcagcctcctgagtagctgggattccaggaggctaccatcatgtccagctaatttttgtatttttagtagagatggggttttgccatgttggccaggctggtttcaaactcctgacctcaggtgatctatctgccttggcctcccaaattgctgggattacaggtgtgagccactgcgcccagccagagttttttattttaatgaaacccagcgtatcaataatttctttcatgaatattgcctttggagttgtatttaaaaacacatgtgtcatcaacatattcaagatcatctaggttttcttctgtgttatcttgtaggaattttatatttttgtgctttacatttagatgtatgatccatttagagttaattttggtgaagggtgtgtctagattaattttttgttgcatgtgaacatgcagttgttccagcaccatttggtaaattactatgtattctccactgaagtgtcttactgctttgtcaaaaatcagttgatttaattatgtgggtctatttctgggatgtcttttttgttcaattgatctatttgtctattctttaaccaatattacactgtcagattactgtagctttatagtaagtcttgaggttaggtagtgtcagtcctctaactttgttcttctccttcaatattgtgttagctattctgggtcttctagcatgcctttaaactttagaatcagtttgttaatgcccacaacacaacttgcggggatttctactgtgattacattgcatctatagatcaagctgggaagaactcacatcttgacagtactgtcttcctatacatgaacatggaatatctctccatttatttagttcttgtttgattttgtccatcagagttttgtagctctcctcacacagatcttgtcatattttgatagacttacacctaagtatttcatttgttttgattctaatgtaaataatattatgtttcttttaacttctactttttcattgttggtacagaagaaatcaaatgacttttgtatattaacctttaatcttgccacattgctataatcacttgttagttacaggatattttttggtcaattctttctgattttctatgtacacaataatgtcatctgcaaaaacagtttagtttttccttgataacttgtataccctgttcccacctttattttgtcttattagctagaagttccagtataattatgaaaagaaatggtgaaaggggaaatccttgccttgttcttgatcttagtgtgaaaacttctaatttctcaccattaaatgtgatattagctgaaggtattttatagatattctttatcaaactcaggaagtttctctgtattgttagtttactgagagatttgatcatgaatgggtgttgaattttgtcaaatgctttatctgcatctgttgataaaatcatgtgatttttcttttttagtctgttgatgtgatgaattacattacctgattttttgaatgttgaaccagccttgaatgtctgagataaatcccacttcactgtggtgtataattctttttatacattgttgcgttgaatttgctaatattttgttgagcatttttgcatcttaagagatactggtctatagtttctagcatgtctttgtctggtttgctgtcagtgcaattattaggtattagggcctcatataatcagttaaaaagtacagaggctccttgacttacgatggggttaagtcctgataaggctgtaataaactgaaaatattgttaagtcaaaagtgtgtgcttcaacttctgagattttcaacttacaatgagtggagttatctagacatatcccattgtaagtcgaggagtgtagtgaatgtatgttgcttttgcatcatcttgaagttgaaaaattctaagtttgagactatcggtattccctctgttcctgaaagatattgagagaattggtaggaatttttcttaaatgctcagtagaattaaatagtgaacccatctgggtcttttgctttgttttggaaggttgttaattattgatttgatttctttaatagatataagctgattaagattgtctatttttcctgtgtgagttttggcagtttcaaggaattggttcatttaatccaggtcatcaaatctgtgggcatggagttgttcatagcactctttattttccttttagtgtccctgggacccgtagtgatgtccaccctttcatttctgatattattaacttatgtcctctctttttattcattagcctggctagaggcttatcaattttgttgacttttttcaaataatcagattttgttgattttctatattgattttttttatttcattgatttttgctaattcttattattcattttgttctgcttattttagactaaatttgcttttcattttctgtttcctaaggtagaaacttaggtcattaattttaaatctttcttcttttttaatatatgcactcaatgatataaattgccctttaagtactacttttgtagcacctcacaaattttgataagttttcttttaattttcatttagttcaaaatatttttaatgctttttgacatttcgtttttggcccatgtgttatttagaggtgtgttgtttaatctctgtatattttgggattttccagatatattttgttagcggtgtctaatttaattccattgtgttctcagatcagagactttatgatttctgtccttttaaaatttaaggtatgttttatggtccagaatgtggtctatcttggtgaatgctccatgtaaacttgagaaaaatgtgtattctgttattgaatgttgttgtctatagatgtcaaattatatccagttgactaatagtgttgttgagtttaactatgtgcttactgattttctacctgctggatctgtccatttctgacagagaagtgttgtagtctccaactatgctaatagatgcactacttgtctttgctgttctattggtttttccttggcatagtttgatgctctgttattagatggatacacgttaaagattcttatgtcttcctggataattgatcattttatcattatgtaatacccttcttttgtccctgataactttccttgctttgaagtctgctttgcctgaaattaatatggctactcctgctatctttagattagtgttagcatgatacattttcttcatccatttacttataatctatgtgtttttgtattgaaagtgactttcttatacgcaatacataggtgggtttttaaatccacttaaacaatctttgtcttttaattggcgtatttagatcattgatattcaaaataagtattgatatacctggattaatatctactatattgattaatgttttctatttttttctctgttcctattttgtcttctatactgtttccgtcttttgtggttgtatttcattattttatgtgattcaatttttttctacttctttttagcatatcacttgtactttttttttttttttactttttgtagtggttgccctagagtttacaatatacatctatagctaatccaagtccatcagataaccccgtaccacttcacagatgatatgagcatcttataataaaaaaatcatatcctccctcctgtccattgtgtcactgctgtcattcattggacttatatataggtatacataagcacatatattatacgtaagtatacacaatcaaatatattgttactatgattattttgaacaaattgttattagatcaattaggagtaagaaaaataaacatttttattttaccttaaattattccttctttgatgttcttcctttctttatgtaggtccaagtttctggcctatatagttttccttctcttgaaaaacttccattaacatttcttgcaaggaggtttattctgaatacattctttcaatgtttgtttgtctgagaaagtgtttatttctccttcacttttgaagaataattttgcagagtatataattctacattggtgagtttttttctctgaatactttatttatttatttatttattcttttgtttgtttttttgagacagagtctcactctgttacctaggctggagtgcagttctgtgatcttggctcatggcaacctctgcctcccaggttcaaacaattctcctgcctcagcctcccaagtagctgggattacaggcatgcaccaccatgcccagctaatttttgtatttttagtagagacagggtttcaccatttggccaggctggtctcttaaactcttgacctcaagtgatccacccatcttggcctcccaaagctttgggattacaggcgtgagccactgtgcctggccctcttaatacttcaaatatttaactccagtctattcttgctctttaggtcttgttaagaaaaacagaatgctctgccatattatgaaatggttcttcttctcttccccctgccagaagcagcgggggaattttctctaatactcactttgagaagtttgtcaagcttctctagataaatctcacaatatccttggtgtcccctatgcctgggccctcctggagtttttaactctcagacttgtctgcactgatcctccagaaattcatcaattatagttcaggttttcctacgctggtcctggatcctgatgtggtttccgctagtgagtctctgcttcagtaagccatagttccctatatttgcctgtctatctctctaaccttggcgtagcagttttgccctaagtcctcccatctcttacaatctaagaagagctgttggtttttagtctctttagctttttttttttttaaaattattaatttattttttatttttaagtatatcttatttattttattatagaataaaacctattttaaaatattctttttcttcagacatcaggaatttttatttatttatttatttatttttattatactttaagttctggggtatatgtgcagaatgtgcaggtttgttacataggtatacacatgccatggtggtttactgcacccatcaatccttcatctacattaggtatttctcctaatgctatccctcccctagccccccaccccccgacaggccccagtgtgtgatgttcccctccctgtgtccatgagttctcaataggaacgcttttacactgttggtggggtgtaaattagctctttagcgttttacttgttaagatggagtggcaacttccaagtaccttacatgtgtaaccggaaacaagctatcatatatttttatgcctataagtcattcactgttttcatagcatgtctggtattgatattaatctacaatatccatttgagttgttctatcacttttgagctctcattgaggctgtagtaagtcaactaaagtcataagatttgaatgcactatacacaaacaaaaaggtgtgttttccacataaaatctgtgcatgatattttctttgcttttatttaaaaggtcatgatatagtacctgcaaggttatggttcatttaggaatagagcttttcaatggcacataaagagcttgatttaaaatgtgttattatgcatttatattccaattataaacttcctttcagaggctttaacaaatattcatttaataaactacctttctaaattaaaaaggttaataattaatgtagtattaaaatgtaacataggaataaaaaagaggttaataataaaataatgaaaactcttaaaataattacatggaatgatgcacaacatcaaatagtctgggtacattttccaaaaccatacatttaagcacatgggtgttgtaaagattattaaaacattttctttaaagattttacattcccaaaataaaattctatgtcaatacttattttaataattttatgagatttagctctttgctctcattaactatgattgcatgtttaatgcatgttcaattagataatcctggcgtgtacattagtggtactgtgtcttaggcaacggatggcaaactcctagaggacatgggctatgtcttctagctcatcatgtccctgtggccagaaactcatcagcctgaagcagctggattaatagaatggtggaatggccttttgaagtcacaattataatgccaactaggtgacaaagctttacagggctggggcaaagttctccagaaggctgtgtatgctctgaatcagcatccaatacacggtactcttcctcccatagtcaagatacatgggtccaggaatcaaggggtgtaagtagaagtgacaccactcaccatcacccttagtgacccactagcaaaagttttccttcctgttcccacaacattatgttcagctggtctagaggccttacttccagaggaaataatgctgcaaccaggagacacaacaacgattccattaaactgcaagttaagattgccacctggccattttgggctacctctcagtcaacagtctaagaaaggagttatagtgttggctggggtgattgacccagcctatcaagatgaaatcagtctactactccacaacggagataaggaagattatgcatggaatacaggagatcccttagggcatctcttactattaccatgccctatgattaacgtcaatgggaaactacaacaacccaatccaggctggactataaatggcccagactctttaggaatgaagatttgggtcactcaaccaggcaaaaaaccatgacctgctgaggtgcttgctgaaggcaaagggaataaagaatgggtagtagaagaaggcagtcatcaataccacctacgaccacgtgaccagctacagaaatgaggactgtaattgtcatgagtatttccttcttattttgttaagaacatgtttgtgcatgtatacacttttactaggaaaatatcttcattttatttccttttttcctttatcatgtgatgtaagatttattgacttcatataagaatttaagtgttaactttatgtaatagcaattagggtaaggattaatgcacttctggttgtgcaaagaatagctgtgtaattatgaccttattattgtctttatttggagattatgtatgatttcaggagatgtgtatgggttcatgttgacaaggggtggacttgtgatagttaaaattgagtgtcaactggattggattgcaacgtattgttcctaattgtgtctgtgaggatgttgccaaaggagattaacatttgattcagtggactggtagaggcagagccaccctcaatctgggtaggcaccatctgatcagcttccagcatgactagaataaagcaggcagaagaaggtggaaagagcagacttgctgagtcttccggccttcagtctcatgctggacacttcctgccctccaacatcagactccaaattcttcagcttttggactcttggacttacactattcatttgtcaggggctcttgggccttcatccacagactgaaggctgcactgtcagcttccctacttttgaggttttgggacttggactggttcccttgcttctcagcttgcagacggcctatcatgggacttcaccttatgatcatgtgagtcaataatcctttataaattccccttcatatttacatcagatatacatctatcctattagttctgtcctctagagaacgctgactaatacaatacatataagcacatgggttttgtaaagattattaaacattttccgtaaagattttaaattccccaaatatgattttatgtaaataatattattataattattttatgagacgtagctctttgctctcattaactatgattgaaagtttaatgcatgttcaattagataatcctggtgggtacaagagtggtactgtgtcttaggcaatgtatggtaagctcctagagaacatgggctatgtcttctatctcatcatgtccctgtgggtggtaatttgctggtcctttttatcaaggtacctgatacatagtaggaactgagataatatttgttgaatcaagaacaaatgaaagaatcattgagatgtaattaatgcttgttaaatgcaatgctttaaaaagtcaaggacttgtaaaaacacacaacttactcttttccaactatgtctatcctattacctcacagaaattctaagtgaaagcttagattcattcactgtgaaacatgttgcataccctcccacttgagagactctaccttggctgcctgctcaaccttatatattcttccccagacatacacatggtgttcttccacatcttctttaagcctctgctcaaatgtcactgtctcagtggcactctttaaaactacagggccaggcacaatggctcacacctttttgctgaggcaagcggatcacctgaagtcaggagtttgagaccagcctggccaaaatggtgaaaccctatctctactaaaaatacaaaaattagctgggtatggtggtgctcacctgtaatcccagctaaggcagaagaattgcttgaaccggggaggtgaaggttgcagtgagctgagatggctccactgcactccagcctgggtggtagagcaacaatctgtctcaaaaaagaaaaagaaagaagaagaagaagaaaaaaaaaaactacaaacgacctcctcccagctctattttattttccatagaactttctattatatcattttcttatttaatatatttattgtctttctctctgcagctgaaatgtaagctccaataaagtgagaatctttgttttggatacagaatactgctgacatagagtagatgccctgtaaatacttgtggaatgaataattagacactaacatatcatttgaaagtctttttgcatcagctacccgatatataaaatgaaaataatttggttgccatacttatttcataggactgttcttagaattatattgtatatttgacattaaatagttttcaataaattcaacgattattttgataactgaaagaataatgtcatattcagatttgccttttttctacaatttagctagagtgcaaacaatgacattttgaaatagcagaatactttggttttaaacatccggagataagactttaaaaaatatgccatcggaaagggtaaaaagcatcatctttatatgctcctttgatctttctgtagtgtcacattgtgagcatattatatttgtgaattaatgcagtttaaaaaagaagtagagctatagaaccaaagtttatagatagatttatattttataaatattttaaaattatttttagatttaaccaaaatgctagaaaattcaccaatatgtaacatcactttttagcaaattatgtttcctagtttacattgcttgagcagaattgatattaaaaatttttgtcctacttacacagaaaaagttcctagaactgtgagccccagacatgtgtgcctctctgatttgaaggacccatagagggccactattgcaaacagatactacgtcaaagatagaatagtgagctgggaatggctacaatgttgggtgaggaaagaatggacggtggggtcaaaactaggaatcatgttctttacctgaatggtctaaagggcatgcattctgatcacgcagctggatgattcttttccaatccaggctctacatgagacataaagattttcattgcacttatctgtctcctatgcacttcaataatactcatcctctttttccccgtgagatcatctccttcagtactgcatcttcaatgcccatctctgagctggcacaataatgaagctcagtgtaaatagtgaatgaataagctaatgatcctgtgtactattcctgcacaaatcaagtcaacttcactttttttctgctctccttcctcccactttatcatattccatcctcactacaatttccctcatctctataagatctttctgtacaagaaggtatttccacgtttgaattcacgagcttccacctccattttgagctgtcaatcctgctaacaatgagcaccccagtaaacaacaatagaaaaaaaaaagtaaaaacaacctctaacatgtctcactacttaggataatgattaatgatactaaaataataaaatattcatttatcattgaatactcataaatcattcctttgccttaatatgcagttgatgcttagggatcaaccaaaaatgtttcccacatttttaaaacatcatagggtttaatcttcattacaaatttcagttcaaaatgtttcttctcagaagcatgacaaagtgatttagagtagaagtagtgaaaggacctttttcaaagtgattggaacctttctggtatagacgttaaacagcataatgaatgtgttggcatttgtttcttatttgcatactataaaaataaaacagagtgtacaacaagttcctgttaaattcatattacctgtttaaataaggatattcaaaaggcaatgtgatctaattaaaatcaagaaatggtattcaagccatatttatatacttctatgataatacacatgcactaatatttacaatgcatgcaaagggtatacacctcattaagcataccgggaggaaaattccccaatttcttcaattcaactagtcatttcataatttttttctaatgtgaatgttagctatttcaagtgctgaactaaagtcacatttaactataatcaatgcatttgcagttgtagtccaaagcaaactctgaaggacgttctcatagtctaaaacttgacgcattttgaagataatacactgaaggcttgaaaacaaactatttactcccttaaatgtgcctttttctcattgttcatactttccagcttgctcacaaatgcccaaatgttgatatcaatgctgtttctaagaaactacaataaggggtttgttttgcaatcttttttctcccttctcccacacataatcacatgatctttgaaacttacaaaacgaataggagaaacgtatcctttcaaaatgaagtaactttatggggttatagtcctctaagagcagattatgcattttttataccataaaaatttgtcaatttggaagtctgtttaaaatataaatgtataagcatacctttgtcttagaaattattatatgaaagtatggacaattaagttttaggaaaaaagtgtacgactacagttttgggtcattaaatgcatcctgttttgagagttgctatgtattttcaaagagcattataaaatctatagcactgattgttttcattaattagaataaagcaagaacagcctctagaatcacttgatttaaaagacaaattctggttcagaaccttctgaattatttacaaccaactccacttggtctatcatttaatgaaagaacagaaaggtgtccttcccccacaccaccctaaacgagtcatcatagtagaatgccataaaagcctgtgatgaggattttagtctcagatgcagcctatgtccccacatgtctcataaattcttctaatgcattttcacatccatgatcatgaatgcctattcaatgaaagggtttatcatatgctacacttttcaactaccaagaacaaagagtaaatggtccctggccccatatttggaacaaaaagtatgaaagcaaaacaaaaacctcttacatttttactaaataaaagaatgaatgcagactgtaaaggctgagtggaaacttcttttggcaccatgatgttctttcttgagaccatgctgcgttttctctgctcagtgagggacagatagaaaaaaatggagatacaaatgtagtcaacctcatgtgtcacccaatccatcttctccctactaaagaactattcactacattatagcattaaatgtttccatcagtatgctttaagagtaatgcggatttttgctatctatttaggaggaattcacaatatagtagaggtagctactgtcaagagtttttcgttgtttttttgtttgtttgtttgtggactggttctggctctgtcacccaggctggagtgcagtggcttgatctcggctcactgcaacttctgcctccctggctcaagggatcctcccacttcagcctcccaagtagctgggactacggacactacaggcccatgccaccacacctgcctaattttttgtgttgtttttgtagagacagggtttcaccacgttgcccaggctggtcttgaactcgagctcaaacaatcctcccacctcagcctcccaaagtgctgggattacaagctagtttttgtctttcaatttctccctcaagctactcgtaattatacccctagatcaggctaagcaatttcctatcctctttttttttcaacatattttcatgacttggagtattatttctcattaggtaactatcagccaagccagagagatttatgcatttcttaagtgcacaacatactcacaccaaattatatataaataatacatacatatgtatacatagaagttatatgtagattataatatatacaagtacatatgcacttttccttcaaccaactgccccagtgacttcactcagaaatagccacctatgagacaaaactactcaacaaaaagaaataaaacaaaacaaaaaaactaaaagaacagtaaaaaaacaaaaaacacacacacacatattaaaaattctacaacttggaaggagacataccaatatacacatttgatggcaaatttttgtctagtctaggaaaatgccttcttttcaaattataatttattacaattagtctatcagttggttatcagccttggttgagtagacaatttccattcaaggactcactgtatcaaaatactatttaaggcaaatatacagtagatgctgtgaagctcagtaatatgggatattatccctatcttatggtcttgaagaaatctcataaaaataattcaaaattaattagtggctacatttcatgtattataggacttgtacagtttcggtcaagcagtggtttcatggtgccatttttctgatgtgcatcagagggggctcagaatagaaaattcatttgggtttttaactataaatgtaggaagctcaccttctaaatacactcttgccttaacagtgtttattcttatatagaattactctgtcccacttcatttcttactggactcttatttatttgtagaagagattgtattcttcactgaatatgctgtagctagaaaatgtcttagttaagtctttctaggtgcgaaatagggtcacagcctatatcttactaggcgtcctagcagtaagcagtactgaagcaataatattgcctggcattgtgtttggcttttagtttggctggcagggccagcttcttccatctattcatcctaaataacattgtcagcaaatcttttttttaggcaactgcaaataatcttcattagactatctcattctttttttaaaaaactcattaacttatttcacttttagctaatattttctttatcaaatgagtttctgtgtaagtagcatggctgtttttacttcctatgaagctacccttcctaaagctataaaagaagaaggagaaaactttcattacgggaaaaacaaacaaacaaaaccagaacaaaagcaaacaaaactctacaaaaccagaataaaggcaaacaaaactctaggacattggtagaatgaaaagctgggaaaattactatcaacacacatagttttcagactttcttaatttaagcaactgttgtagcacagtcattgatcctatctaaatgaatcaggatctttttcacaatctccagcctcaatgaaataacacttcatctacaattatattattattattagagactcacactgtcacccaggctggagtgcagtggtgcagtctcggctcactgcagcctccgccaccagggctcaagcgattttcctgcctctgcctcccgagtagctgggattacaggccaccgtgcccagctagtttttgtatttttgggtagaggtggggtttcacatgttggccaggttggtctcaaactcctgaccccaagtgatctgctcaccttggtctcccaaagtgctgggactacaggcgtgagccaccatgcctggccttcatttacaattattaaaaaatactatgcttcctgagttgtccatatttgaatgagatacttatgaggaatgtggcattttccatgctttattactgataaattttttggacatttctgctgcatcatccattctctgtgataaagattgtggtacactaacaggtatgtttactcctatagcatgtgcagcttgtacagggtatggcttttaggaagtaatatcattttaaaattaattgttaatttctatgtgtttgtcctgtcttcccaagaagtttatactcctttgatggtggggtctctttcttataagttttattttctcgtatataatgtcttatacatttatgagtcgtactcctgattagtagataaggtaactattcaataatacctgtcttacaataaaaaagatgaaggagatgacatatctagcaagagaaatccaataatattaatgcttaagaaccattgatgtttcagttctcatttgtcagaatttgatattaaattgctttttgtcaagaatctggaaaaaacatgtcataatatagaatcctttataaaaagggcaatctaattccttatagctcggaaaggacttcaaactgtgtcattccatttgccaacaaggaataaattcacataaattaatctctcattcatgtaatgtagtacagaaatttatagtcttgtcaatagttcatgtggagctataatttgggataggtaaaggaaatgtatccagtgactgtgtatggtgctatatccttccagaatcaatgactgagaaaatgttttactctctgattttctttatccattagatatcaaatgtttggacttctctcatttttaactttgaaaatgctattctgttttagttccaaggtatacagtgacatgcttccatcagaaatggatcctagaatactttgaagccactgatatatcacttctcttgaagtatttctgtggtagtcagcagttggcattgcctgtggtagaaagcttcacattattcttggtgaaacagaaaagaattctgtctggaaatcattagggatccatgacctataaagctctttgcaaacacaacacaattttaaacaaatgcaaaagtcttgctccactcatcactggaatggcaggattaattaatatcctcctgagatatccttaacccagaggtgctcatcgaacccccttttaggtagaccttcgcttcatgtgcagccttaaggattagttgtcagcatttaccctcaaataaaatatagccacacaaatattaattaaacaatttcaattttcaaaagagtgtctggaaagatctggagccagatatagtgaagtctgactactatttcccctgcttgctagctggagaaatatgttcctttttaaaattattactaattaaggcacattattaattatttaaaaatgaacatatttccctaaaccctacaagagaggccatataatctagtaaaagagcatgggctttcacatttactagctgtggatcttgggtaagcttcataatgtcttggataagttaagtaacctctgtgaccctcagtctcttcagctgtaacatgaggttaataagagttgtcttagtgaattgttgagttggtttttaaagcatttctatttgtttatttgtctatttatatctctgtctctattgctatctctatctccattgcttcttttatatctgtattttaaagtgaaaacttaaaagcactcaaccaatattagctacttcctctgcccctgtaattatctaaaattattatatatgtcttgcattcaaataatcaaccaaatatgtaaatttcaatttcaacaaataacatactctaatatatgctttttactgtttagtaaaattgagctgaaagattgaaggaaatgttcatttcttttcaacaaagctacacatagtaagcaaaaattctttaaatagccatattgtgttgcctgatatatttgattttgaatttattttacgatgttgttttcactttaatttttttcaatattgaaatacaaatgagcttcttattaaaaactacctagaacattgagtcccatacaataagagtgttaaccattgtaaaccctgtcatgtctctgggaagcagaggaattatcttgttatcagtttaataatggaacattgaagtaaatgatgccatccactgacaccagtaacactgtctctctggggaaattcatgtctgtgagaactgtcaatctagatggatacagacatattaaacatactcccttcaatccataaatccaccctttctgggttgccttaataaaaagatcccttattttgataaagacaagctatgcagaatatcttgacattactgatctataatccctttattttaaaaaagtattttgtggaaggatttagtaaataagttaacaaattttcatctacttcctttttgtgctttagcataacttacatgtaaacatgttcctgaggttttaaattaataaagtattaataactacatagagatgtgggaaatacatataatgtatttatttccactacttgctttggcaagctttcttcaaaacacagcttacttttgttgttttgcattaaaattgcctctagttctaattgagatagatataagatgattttttttttttttttgagatggagtctctgtcacccaggctggagtgcaatggtgcgaccttggctcactgcaacctctacctctcaggttcaagtgattctcctgcgtcagcctcccgagtaactaggattacaggtgcctgccaccacacccagctaatttttgtattttagtagagacggggtttcaccatgttagtcagactggtttcgaactcctgacctcaggtgatccaccctcctcagactcccaaactgctgggattaaaggcgtgagtcactgcacccagcctaagatgatttcttatattaaaagtatcacacgttttcccatgagaaaatatgacaagaaaaagtaaaaattatcaacataaatatatcaatgaaatatacaacagtagaacataatgaaaaccttctcagtgcaaaaatacactgtattacagaacaagcaagaaccaagaaacaagttgaattgcattgttagttaccaaaatgtgttggtatatcttagtttgccagagtagactaaattgcattaatggacacaggtttcagccaaagcctagaagcaatgacacttaccctaaagactgaaaaaggaaaaataagtatactgaaaaaaggaaaagaaatccaaggtggcagcagggattctaagaaaaggctcttataacctctaactgattttgaattcttactcccagacaatgatgtttcagggtagagagggcctacttgccatgagatcatttgactttttcttatctaagtgcttcctagacaacccaatggatatcccacaggcaccagaaactccattatgcaaaaccaaattcttcatctcccttcccaaatctctacctcctggtgcattttacctttagtgaatggagccatccaacatacagttgcttaagtgataactgaaaatcactgtataatactttcttcttcatatgcaatatatgccctactcttgctacttgaataatcaccatctctggtaattccaactcctataccactcaaaaactcatcacctcttccacttccattagtctgctgtagttccggttatccccacttattaccaggtcctctagacctggtacgtaatcactattataatacattatgatttttgttattcacaacaacgctgtaaaataggcaccgatattccaattttaatgacatctttgaaaattaaaaacaatttttgttaaaagttaattgaaacagtttagaagaattgaatacgatgagacaaaatctacctataaccccaccctctgcctccaggccttttccacatatgtgaacactattaatgttgtgtatctttataaaaatatattttttataccaaaaagataatattaagcatacagttctgcaacttggactacattaaaaaataccacagtaaacatgggtttatacctatgttggcaattttatccactgagtgaaattttaattgagaaatttctaggtcaaagagtgcatgtattcaaaaattttattgctatgttcaaattgttctgtagaaagaatgtacaaatttataatcctactaacagattctgacaatgcctattttcctttattctcgcatagtcttcagaatcctagcaggaaatagaaaggacagtcaattgtggataaaatgaataaatgttatgtaaccacttacaaagatatagccttgtgcaggaaaaccacaagggacagtagaggacactgggagtggcagtaaggacccaggaccatcttaagaccagagcctggcaaaaagggccaccagacatgagctgagatttcagtggcatccacaggtacttcacagtgaccctgcaggaggcctccccctcctcagtctctctgatctgtcctgactgagtccagctggaacctagagggcaaggtggccaactgaagtaggtccgtcttccagatgcagatactgcgtcgaagggaggcgagtggatctgagcagcaaattgaagacatggagaacacttcgtaattttctggggttgaagatgaaagagtctgtgtttaatgtgaaaacttgtagatttttttaccttgccatgttcatttctgaactcttattttttccttggctaactggttttgttgtctctatccttgctttcccttccatcaagtttctgcagagccactcaaggatctttccaaaatgcaagcaggatcatataatttctctgcataaaatctctcactagttctccacctctccagggtaaagctgaaactcctaggcaagcataaacggcctttcgtaactgggctcctgcggtctagggatctctttccaaccatcatgtctgctattctcccatctgtattcagcactcaggcagtacagagccatttgtagttcccggttgtgaaatattttctcaaacttcaaaggtactgcatcactctgctggtaatgccagtgccttctctgcccacacgctgaacttctagtcattcttcaagatgccaatcaagagtcactttctctggaaggtcctaatcaacttgctcttgtggtagagttaggtaattaatactctgaactactatgtgacattgtgtgtttctcatctgcacatagttttctgaaactatttagttgctgccttcccccttgagattgtgagcactgtgacagcaggggtttgttccttgttcactttattcatttctctcttcagtatttagcacagactctgatgtcttacggcctatatattatcttagtatcttcactaacttgccatgtgtacttggtaaagccccttaatttctccaagtttcctagctataaaatggatgcaatattagtgctaagggtctggcaaatattaactcttttaactctcacaacaaccttaagagttaattttagttaagctcttggcagtatgtctggcacacaagtggtcaagaaatgttaaatcttcatgtattgtatcaaatcaccaaggatcttacttccagagattaactatttgcatgaaaaaccattagatttcccaagagaaacgtgaaaagttttggggcctcacactaagactcgtgaggttatcaagcttaaaatttctgagcaaaaaacaaaacaaaacaacaacaacaacaacaaaagtgattgcctagaaactttgggtgtttgagaaacgtaaggatgggtttttggtcagtttttatttattgcctaatccagagaatacaagagtgcctatcccataacaggtgacaataaatatttgttggaagaatgtattgtatgtgctttagtttgggacacagctgcttatcaatatggatcagtactgtggcccaaggtgagacacaggcaccctgtctccatgtcagggggatattactgcaactcctcagggaggtggaaacacaccattcaaagagtaaagcaacactctgagcatcttaaagactattatctctggtggaaaattctcagcttcaaagactccatggcaagagcattaggaagaatgtttccaaaaactgatatggggggattttctggcagaggtgagtttctgaaatggtacgagtgaaatagtcaggcatataaagcgctagcccctgaggatgggagcacagaaatacagaataggggcagtggggattggagttctgtattacaatacccctgaaattgttgtttattcctacaccttgtgttttacctcaggaaagcaagagatatggaattgttctcaccaatagttgaaagtgatattaggaattaacttttttaaaaaagcaaagacctaacaatcttttagttatcagcattggttttgggaagtatttttaacattattatattaaaatattaatataggtagcaatatttgaatatggaattatttacgttttagaaaatgtgcatttcaaataaaataatgcacttattagcgagagttttacaattaaagggaagacagcttgcacaatttaattgtttagtctttaacaagggaccatggaaatgactggagaagccttcagaggacaaatgactttgaattagaaagctaaggtcacatttacagacttactctgataacatgtttgctgctaactagagattgtagtagactgacctaggagaagaccaagaatgtaccaaacaaaggagaggtaaagtagagtaaccttttttagaatgtatttttctggtctggatttcagatgtctcatttcctacctccacgggctactgggtcactagtattacttcacattgtacaggtcacaacaaggaccctgagcacatgacagggtggtggattctgggagttcattccctgagcacctactatggaccaggaattggactagattctgagaatacagtattcaagaaaacatatatgacacttgcatacttcaagcttgtgatccagtggagaagagaaacattcaaggaacattaacacaatggtatacattacaaaatgtggtaagtgctacaaacaagatgctatccaaaataaatgaatgagtaaataaataagtggcctgtaatacagttcaccctttcaggcaatgtctccatgtagaagtgacatgaaaatggaaatttcacagatgagctggaatctgttttgggtgaacaatgactcaattcaagtaaggggaatatcatacatcaaggtccacatgcaccgagaactaggcatgtttaaacacacagaaaaagccagtattgctggatgttaatgactgagcagggaatggagtgaaatgctgtcatggaagcagacagtagccacataaaaatgttggtcctagcaagagaaatcatattgtaatgattttactagggatgaggtagaaaatgctccagctctcctatgctgcccatatgcccattttctttgacttgaagatggagctgaacagcactgaattcttgattttattcaagtctttgagtaaccacacaacctctaagctcattttctgtctggttcatagtctggccaagtggaaagaggggtgtgattatggctaagtggggtaggtggaaggaaagcagcaacttcctttgttccttccctttcagacctgatattatcctaaagaagagagtacaaaatgacattgcttccctcctgctggggagagtgcagaattggtcatgggcaattgtgagcactgagctgacatagtaccctggtgacccgaatgagttaatgcattgtcctaaagctctaatttacaaccaggaagaatttggggcattgagaggcagattgaataggtccatttttacccattgtgatttcagtgacaggaccagtttgctctcgtctaaactggcccaccaaatcatgcattcagacaattgaatcaccaaccccctgacatactgcagaatctctgcaatgtaacacagcactgtcacttcaggttccagcttaatgtaccctttactttctagtcctcttctctctttggacattttgcactgaaaagcttctctgacactgattacaaaataagaaattaatattgtcattcatctttccactagcctgtgagtgcaaaatctttccaataaacccactataaaaccaaatatgcagccaaaaatagacctagtcctcctgattctcagatttgcacctctttaacacaccgacactatgacacatctgtttgtctttttatgtagaactttcttagtatataatggtatttatttttatctactaatgataacaagagacaattccaataacatctaaagccagacaattaaacaaactacattaaaagctgttcataagtttaataaaaatgattatcttgaaagctcttaatattcttcagatcaaaggatatgtggaaaggatatgtgaaaacccattacacctatagtaatgggtgtttcgtggttacatggtgaggctctagaacttttgataggatagtttatgcagaaataaccataatgctgcaggatggaaacagggtagaaatttctctttcacctcctgaatagaaaagacaactgagagtggtggtcagaatactactgggaaaggaaacatagacacactgttcaggcaagacacagaagcacagtgtgaaaacaagacctgctagaatatgaaagaagcatcctttactcccataggttaaagaatgtcaccagaatcacagtaaggagaaaatgaacactgattatagttgctatgtgtctttatcatttcttatgcaaatattcatagtgaatttctctataacactcattatatagtttgggctcactaattcttataggataccttttgtcaccttcgtaagatcgatgtttctccagaaaccgatactagcatctgagctagtatgaaccctttaaatattatattttggattcttctgcccacagtgaactgaaaaaaatccttttctgaatgctgtcttattgaaggttaattttttctcagagttttccacaacatataaacccaagcaattaaaagttcttaaactgaccattgtcagcttctcacattacctttattttagtatgttctgaattagttaagcacagacttaatcaattcagtttttcagatctgaaaatttttttgtgttaaaaatatatgaagttataacaataatatcacatcaatttcatataaatttcacagactctgccctagaaaacctagggtatatgatgactatgcttagggtatcgcattataaaatactgataaactttttttagaaaggattaattaatttgaaatctccagatgataaatatgtgtgcttctgcatcaatactattttttaagcctataagaaaatcagcagtataaatagatgttaccacatttcaactaaagaaaaacaaataaaaaatatctgccataggtctccctcttacaacaatataatataacagattatgaaagtgatctccaatgatttgcctatttagaatctttcggtagaaaacaattaagcaaatcgagatatttcagcataacattataaaggcaaaaaccatcaaagtagaccaaacaattattatcctattaaatattaaccaagaatattgttactaaaactgtaaaaatgaagaaagaagggaaacttagagatttcggctttcctgttatgactataacttttcaaaatgttagtctcctttactgacccagcacttcattactccagagggaaatttagaaaaggtcttttatagaaacagatgtctacgaaggcatctataatgattcatatatggttgggatcctacatctatagttgaacttcaatagccagaaaagtacatctgacattttgcaaacagactttgtccaatcatgctatggcttcacctaaatcccccaactctggtcaattcccctgcataggattgtaaacaagttcacatttgaaccctgacagcattcttttcattaatgcctttttcagaaatttcacttgtttgcattttagctgtacaatttcatacatattatacatttcagcttcagtttaccaaaaaaaaagtctgcatcttaactctttaaaactataatcaaagaagaaagtaaagcaaacattaaaaaaaaaaaacaacatttgtcagttctgagtggttctatgcaaaggtgttattacattattattctatgaaaataatttcattatttttcattttttcaaaattaaaagaaaggcattagttgacattagtgttcattaaatataggctggaaaaggagggtagcagaatcagaaattggcttagaattagagcagaaaggaggtacgaggcaagaggtcatgaaattgttaaaagtacacgtggtgggagatatagagataaggacttcggttcagatgacaggaacacagctttcaaaactgcagaggtggcaaaattctttgggaaaagaagggcaggagctgtctatggaagaaagtcagtgacatgatggcaaaagtaactagaggatgatacgtggtagcaaagaccataaatgctgacagcagacaaagattaaaagtaatataccaaaggtctcatgaatatttgggggtaaggaggaagaagagaaagaaatgcagagcaaggacccatgaggctgaaggatagaaagagtgtggcttagtctaatagaatatggtttggtgacatagaatgctgactcaacctctctccaaatggcactgcgaagcaggaagagtactggatgcaactattggcttaaaaatagaggagtggctctatagtggggtgggatgaagggtaggcagagacaatggaaactagtgacttctatttgagagatttttaaggaatactcctctttttcagggttaatagatattttagtaaaggcaaagaggtagatactaggatctagaaaaaaatttaggttatcaagagatgttaagaggatatgtttcaaagagcagagtcaaaagggaggtgctctagaaaagaggagagttaattcttgttgggtggtaactgattagagaatattaaccttaagcaatgatgcatgatttttataatgtctttaactttttaggccaaactagaatttcattttatctgatgtctctgcaaatttctatggcataagagatttaagattcagagttggtagaagaaggactttatttttatgcagtatataatatgtgaattaagttgttatgaacctatagtatttcttagttaatcttcaaataagtcctttaagaaaattcatatctacaactactacctcgggatactatgacccaaaaggagggctatatatccaaagatttatcttttattgtttgtttttgagattaattatctgtttatgaagttaaatatttgttggtactatccatcaaaaggtaagttttctgatattggaagtcttaaagatcagacaaaaatgaccttcacttttttttttctgattgttatctcaagagccaacataaacctactcttatttctgcctggccaaatgactgacatttgtgtttacctaaagatctataccttcagcacatacaggcgataatataaaactcctgtgtgtctgttgtaggaaattactaagaaaacataaccccaatccttcactctatactaggtaccaaaataatttcacaggtgatttaaaactcttaccctaatcttcatgccccaagtgcaatgtgacctgtctagccaggaaactaacagagcattctctcccttcctctttcggtcttgtgttccccagctcccagcagtggtctgttcccatagttaacctcacagaacaagataaagctttcttgcccaatgaagcaagaaaaaaaaaaaaatctctccctgaaaatgcacctccgtctcaaacattttttccagaaatagatattaatcctgcccctttgcccactcagccaacagtcaaagaacctcagaatataaaaattctcagtaattttctatgttgctcccatcaaaccatttcattacatatgactaaaatggagtagggaatagaaaatagtatgtattcacctctggaatgatctcatatattttccaagcatgagatcccactggtttctcttatgtgcaattcaaagatgcctaaaaaatggctaagtatttatggttcagttaaaatataaaagctttttcttctactattcaatacacactgtaacaatacaataaaagttatacattacgaaagtgatttctgagcctcagtgagaggtccatttaatcaaatcattgtcagaagtgtagtatctctaggagagtgaccttgcccaacctctttgtttatagatgagctatgacttgcccaagttcatatagttggtgacacagccatgaaaggctctagttcttcaagatcatggtacagtatttaaccatttattttaatgtgctccatgattttcccccataacatcaacaatcccacaaattacagatttcctaatacataagtcagttttttaaatctatttttggaaagaaaggcagttcttcaaattctgaacatgaaaaagaattttttaaaaatttagtgcccagtgagtacttatgtaaatgaatacaatgaatcagatactataggacaaattagtaagatggaagcaatagaggcaggaaagcagtaggttttgttcctggaagtttcagagtttgagctcattatttagaagtaaccgggagatcctatgctagtaggcagctaagactaagaaattcaatcagccagccaagaaacaacaaccactaaaagcaaaataacaacaacaaaatctacttcagatttttaaaaattaaacttcataacatctcttacagacacaagtgattcagataaattgaaaatgaacatgttgtccaaaattcagcaagtccttaagttttcttttttttttgagcatgtgtaggtgtttttatgtttgctcatgtgagtgacagtaagaaagatttcaaaatgtgaatatgattatgattaaactgtagtgttaatttagcctgagaaagtgggctttttgttaatagattattaggtaaatagggtattaaattttttaaatcatttaaaaagttttataaggattcaaataaaatcaaaatatcagttcaggaaaatttaagagcttaagtagtaaaatagtgtgggcatttttagaaatgaacattagacatgaatttgtatttggggagtattataaattacaacacaaattattatgtagtcttaataatcatacagagataatgttaaacattcatctcaaactattaaccagggtaacctgatatacatcttggtaaatctgagttaatgaagaattatcatttgttttactaaataggataatataattgtaccatatgtaggagtagaaatattggtatgctttctaagttgttttattttgcaaaatttgattttctattttacctaaaaaagtggtatgcttcttaaatttaaatcaatagtgtatctgtaaataaatttttacttaagaaataacttcagcatacattcatctgccttaatcataaacagaaagaagtatcttattttctctttattctttttttggaggtcaggaaatatgattaggtatatggtacatttaaccgttgtgtatataggagagattgaaaactctgaggttcaattcctgggtttgccactttctagtctttttatcttgagtaagatacttcttattttttatgattagtttccacatttgtaaagtaaggataatgatacctcctgtctaaaattgtgctgagaattagtgataaagtatgtctactactcagtctagtaactggcacaaaaacaagtagcttctactaacgaatttagtcatcattaattatgataccctgactaatcaatattggcaacacataattctaaaagatgtgcatctgaaatttaatgctatactcttgtgttttctctggatttaagaggaatagggatgtggagaagagggttgtggagaagggggggtaatcaataatcaaaatcatatttaagaaaagaagtatgatatgcttaataaatgtggacaaactgaacactagtttgcacaagtttggaaccaatctctttaacccttagtttttcccttggtaaacaaacagactaagtcatataatgcttgataattaattattcaaagtttctctggcattcagtgtctctatgattaataattcagttacgtttattgagaatgctaaataatggcaactcacatttttcctactatcattaagactgtcctgttccagtgatggctgggagtaaatctgaacataaatcagaaaatcgcaggagatgtgtagtagttccttagttacaactatgagaatgaagtcgtacccttggagaattctagtgtgtgacttgaaatatacttagtaatccagtcactgaaagactgacagatttgctcattggtttctcagattccgcctaacaaggcctacgggacatggattctaaatgagaagaataatttctaaaaagtattttgacagttgcctttaaaaaaacagaaacattttatggcatatgtcctttatttataagactgatttttatagattatttagcatgcttgaacccaggaggtggaggtggcagtgagctgaaatcgcgtcactgcactccagcctgggcagcagagtgaaactcagtcttgggaaaaaaaaaaatgtcctctttcacgtgaattttaataaaatactatgatgcacataaaagagaagcagttgaactgtgctaagcatggggcttggccctaggaacactgcgagactgctgtctggttagtaagcagagtcttatatgcacataattacaagatgcatggattcatgcattaatagaagtatgattatccttccccaacatctgattcctcttactgaaatacaattttacatctatatactttttatatctatctatatcaatttgtaaacattgcctatatgtgaaccaatcctactgagaatttagtagaagtggagcctgagttcagaaggaaaaaaaaaataacagatagcagaacaggcttagcagttttttccagacaatcctggaggaggaaattaaaaaatagggttttagaattgacctgcaggacaattaattaatttattttttcttaagaaatatttattgcgctccccttatgcaccagccattcttcaaggaggtacagattcaggggtaaatgagaaaacaaagaaaaaagattcttacacatagagaaaaaatgttttgtgagaaaacagactccatctgtcttgttcaatactaggttctaaaataatgtctggcatttagcatacattcaataaatattggtagaataaaaagaaaaaaaatgaacaatttatacagaaatgaatattattgaggcactaaaacctagcaatgtgattgagaatgactggagtctggcataggggcctgcttttaaaatgatggccaaggaaggccactgggagatggtaccaagcgagttgatgatttctgctccaatctctatcttatctctttataacattcaattatatgaatgttagaacttctgatattgttccacaggtattggacactgtggcatattttttctctttgatttgtcagtttggggaatttctttcaataatttttatggttatataataattgtacatttttatggagtacctatgatattttgatacaagcatacaatgtgtaatgatcaaatcagggtaattaggatatccatcacctcaaacatttatcatttctttgtattagaaacattccaattccactcctcagttattttgaaatatgcaattaattattgttaactatattagccctattatattactgaacactagttcttattccttctatctaactatatttttgtaaccattaaccaatctctctttacccttccccttcccctcccactacacttcccagcctctggtaatcgccattctacactctatctccatgagatcagttttttatctctcatatgtaagtgagaacatgaaatgtttgtctttctgtgcctagcttatttcacttgacacaatgttctccggttccatctatgttgttgcaaatgatagaatttcattctttctacggctgaaaaatattccattgtgtatctataccactttttttagtccattcatccattgatggacacttaggttgaatccatatattggctattgtgaatagtgctgcaaaaaacatgagggtgcagatatctctttgatatagtgatttcttttggatatattcccagcagcaggactgctgggtcatacggtagttctatttttagcttttttagagccctctcccacacccatactgctttccatagtgcctatgctaatttactatgtcttcaacttcactgattccttcctccatcttgtctagtctcccttaagcctggtcaatgaattcttcatttctcataatgtattcttcacttcttttatttctctttggatctgttaaaatatttattttacaactctctaataaaattccacatcttttcatgactgtttttccacctctcccactagattttttttttccacatttatcatggttattttacgtctctatctgataattccaattctatgtgtgggtctgcttctatggaccactctcaagaatattctgttgatcttgggccacactttttttccctcatgtcttataattttttattgagtgccagatggtttctgtaaaagagcagtagaaatttacagaaataatagtcatccccagaaaagggcacaccacttctcttattaggctgctaattaggagactgagtggattaagtctacagttaagcagagtctgggttgtgccgctgctttagttagattcggttcttcattgccttcaaatgtgtcgagagcagaaccttctcttcagcaggacttgggacttgagtcccagaaagactctagaatctctttacttattgttaatccagtaaccaactttctgaaccaagggatatctcttgctgctttacaggccagctcctaggtttttaggttgctcgggagttctctctgctctctagtttcaccatggttttttgtgcttcaggatatctttctactgatcttcccttcctctagtcttccaaagagccactgcagtacaactagtgaaggcctagaatgcactggggggatttctctcaaggctttttccctgccttagccttcagcagacctcttttaactggaggaggccctgcttgccttaggggggatatctctcagcttggctgccttggctttacatttggttgacaattcagtgaagtcccatgagacggttggttgatgagtgcagagatggtccgtgcctgggcttcttggggttctcacacatcacacaactctaaaaacattcattaaaagttctttacaattttaactggtgtctctacagtgacatcttcctttcaccatttctccagggagcaaagcagtcatgagtttctgctctccttgtcactttctgaaatttagttcatttaagtttatttgcattttcagattttaggtaagttttttaaaagtctaattttgtggcttatatcttttgttatggttattagggtaggagtaataatctcttatagctttctacatccttactagaagcagaagtcctgcctgaatttcaaagtcataagctaaccatatggtatctattatcctagcagtctgagtttgaattggaaaggccttggaaggttttaagcagagattaggcaacaactgtgagtcataaaacatttcatacaactctgcagttgaatagtatgtatgaaaatatatgaaatgtaaagcatttgaggaataattatagtcgaggtaacaataataattactgttatatggtgttatatgtcatttctcatattgattgctacacagtttccagtaattcatttaaaaacttattgtacacgtagccattccagcctttaattgtgttcatttcctatattaagacatctccccacccatactttgtaacccaagagccataactaaatttacaatttaaactaaatcaggcacaaaacagtcactgatcattttaatattgaaggttttaaaggacacattatgaaaaaattaaaatgcaaaaagcagcacaaagttaaattaaattatttattatggaaagattagtcaatctggttacttccctaaattttgcatgactaaaatattacagaaaatttccttttggctgatcagtatatagatcagaaactccccaaagaagatgtattaataaagttaactcattccttattaatgctctaggcattttaacaaatgcaaagtgaaatatctacctcaaaaatgactttaatgataagttatttctttgcttcatgtacacaatggataattagttcaggaaaagaatctcagagggagaaaaaatagccaactgtgaaattcacaaatactttccttggattgggtacaaatgctattcaggctaataccagggatgcataaattctttctatcctatttacaatccagtcttgattagttaggagctcattttccagtttgtgaattatctaggtctttgattcttctcttccctctggctgattacctttcccatttctctgctcattagcacctccaccaaaggaaatgaaaatccaggtgaaaaggaaaagtaaatcattcatagataattctaaataatctgatgtttggctttaaaaaacaatctttttattgtgcgtaagtatatatgcatagttttatttaagaaaatacagtttcttagcagaacagtggggactgtgtggtcagatgttctgtgttcaatttgaaattctatcacttactatttaaaaactatccataggaaagtccttaccttcatccagatatcagtcttatcatgcaatcaggatgatattcatatcttttttgtgaggttattgtgaaatcgattcagagaaatacacatctgtatcctataaatggctatacaaaactaagaaactgttatgttttcaatttgtaaaacccctttgtcaattcttgtttcttctactttccttaagaatcagtttgttttggggaaaaggctcattgccaaagtatatctctttttttcttcttccttgctcctttttaaaaaattgtaccttttctctctaacatggttatgaaatacactggtagaaaggttgaagaaactggtagaaatatggttacatctttaccaacaaatttcattgactgattcttccctgcctcctattaaaatggataactactagttacctgtattagtatatattcttaccaaaatggccctcattctaatttgtacttttataaattttggttattaaaatgaagacatatcccacatagtaaaattttcagtaaattaaagaattcattatacacatttaactgttatatcaaagtatacttcatttgtcttattttaaggatgtctggtttgcctggtgattaagctagtagtcctgtgtctctcatgaacagtctctttttaattgatttacaattaattggatcatatttgtggatcacagatatagtttaaactgaatcaattatctaatcaaaaataacaattaaaaaagaaaagcagtcattaaaatacagtatataaacccttaaaaaataatgtgttaagtattgttttttataagctattttaaacaataaagaggatgctttcaagtaaatatcttagaagacctcagggggaaaatgtgaaattagttctttgtgaaaaataaatatctaaagagtattccctgtagggtacaatgtaaaagaataaactagctactggcaaaaaaggaagctgggggagaaaaaaaatatatagttatcaataagcccaaaaaagagtaaaatgaaatgaatagtttgtaacagagctaatgaaacacatatacttgtagcatattctgctaaataaaaactttatattgcctcctacatttaagcctctcataaaacagttgtgcatttttctaaaattgcttacaaattagcagattaaatgggccctttgcacattttaaaggcttgaggggataagtaggaggaaaacaattgttacagttttcacattatcctttctttctccttctttccccagccctttaagagaagattgcattagagttgagttctcaacactgattgttatgaaatagtaccaaattgatactaagtaagattacattggagttgagatcgcaacacgaattgttatgaaatattactaaattgatattatgtaagcgagcctactgaacaaagcttttcagctctttgaatatgaattttattttcattttttgacatgaactgggtatgtgacaaacataagcaatttataaattgtttccattgcctctctcatgagctagtttataccatgaaagactccacattcactgcatcattgccatccccagggtctctttcacatggttcagtgtgttagatgctatacttccaatgtggaaagacaatattctcaccccaaaggcagcctgacaaattacaaaatgaaggggtatttgagaaagagtatgttgtagccagtaatgcttgtaaaatgactcttttaaaaggtttgatggattttctcaagattcttcttttactgaatgacatgaaccaccagcattttaatcttcagcaaagccaaagcttaacaatccaaccaatatttctttcatttcttaatactatctaaggtcatttttaacttcatgttaattcccatgactcagtatcaaagtgagaatgatcaaaatgctagagggtgttaattgactggtaacttgaagagttgggtagggactgaagagctaggtagccgggtgttagcgattcaactcaacctaaaagtaattcccaagatgcattccaggaaaagggctataataattttaagttaaaccaattttttaaacagatttatggaagtatacttctatatatgttatataaagaataaaataataatttattaaagtatacaataaattatacatacttaaagtatacaattttataaattttgacatatgtaatactttaagaccattatcacaatcaagataatgaacatatctattttgccaaaaagtttccatgtgactctttataactcctctctcccactcataacccctctgtccataagacaaccattgatttactttgtgtcactacagatcagttcacattttctagttttaggatgacataataatatatgtacttttgtgaggtgtttttttttttgaatctggattccttcacttgaaataattattttgagattaatccattttgttgtgtgtataatagttcattctttttattgctaagtgatatttcatagtatgaatataccacaatttgtttatcttttcagttgttgatgaaaatatgagttagtcccaggttttttgttgttgttgttgttacaaataaaacttctatgaacattcccgtacaagtctttgtatagatatatgttttgttttctcttgggtagatatctaaaagtaaaatatctgggtcatatgatgggtatatgtttaaatttctaaaataaacccaccaaagtactgtatcagatatatgatttgcaactattttctttcagtctgtcatctgtattttcatatttctttataaacgagtttgaagaggaaatgtttttaatttgtatcaaatcacatatatcctttttctctctttcaaaggcagtaattttggtaggtatctgacaaatatttacctaacaaaggtcaaaagttttcttcaaaaagttttatagttttaggtttctcatttaggtctatgagtattttaagttaacttctatatatcatgtgagatctgaatcaaggcttactttcttgttgcataagaacacccaatttttccagcatatttgctgaaagactatattttgtccactgaattgcctttttgcatctttgtcaaaaatcagttgttcatataaataatttgtgggttgtttgtaggacttactattctgccacattaatctatttgcctatctttatgccaacaccagactatctcattactgtaattttaacatagctcggtatcagaaagttttagacttccaactttgttctttatcaattgttttgtaagtcctttgcacttccatatgaatttcaagatcagcttgtcaaactccacaaaaaaggtttgctaatattttgattgggattgcactttatccatagataaaaatgggaagacttggcatcttaacaatagtggctcctctgatctatgaatacagtatattcttccatttattaggttgtctttaatttctctcagaaatggattgttgttttcagtgttcttatctttcacatcttttgtcagatttatctgtatttcatgatttgctgctactgtaaatgatatatttattttaatttccagttgtttattgcttgcatataaaaatacaattaatttttacaagccaatcttatatccttcaaccttgtcaaactcactgattacctaaagtattctgacagggccaaatctaggataggcaagttaggtatttatctcagctgcaaaaattaagggaatggcaaaagtctcagtaatgaagagaaggtgttttactgtaattaaaaaaaaaatacaatctaaaaacaacagcctgtgggctatctgactgttcctgtaaattaagtgatttttttggttggttgtttctttggtatattccatggattttctacacagataatcaaattgtatataaagacagttttacttcttcctttgcagtcttttatttttttcttctaattggacagggcagaatctctagcataatgtggaatggaagttggtgaaagcagatatccttatttcacttaggaggaaagcatacagtctttcactatttagtatgatattagttgtaggctttgttgtacatacccttcatcaagttaaggaattttcctactattaatttgctgagatttttcccattttaactagaaatagatttttaatttcttcaaatttttttttctattgggtttattgagataatatattttgtgtgattatcactatttagtttataacatatgaactatgctactttcaaatattaaccctatctggagttcctatctggagttccttgtactctttctctaattgtggtatcagggtgttggccccatagaatgtgttgagaagtattccctctattttacatttctgaaaggtatgtatagaactggcactattcttttctaagtagtttagcgaatctacttgtgaagcaatctgggcctgaagttttattttctctaatgttatctattgtctcttgaataagcttttatagtttgtgtccttcaaggaaattgtccagttcacttaagttgattaattcatttacataatgttgttcataatatgatgtcattttccttttaatatctgtagaatctgcagtgatgttatctctctccttttctatattggtaatctgtgtttcttctttttgtttcctgatcagtctggctaaagtttggtcaatttttttcgtctccgcaaggaaccagctttaccttcattgatgttctctattttttttctttttccaatttcatttcttttccactctgatctttattatatcatttattttatttactttgggttcaatctgctctttttttagtttttaaaggtaaaaatgtaggtcattaacttgagactttttttcattttgatacatgcatttggtactataaatttccccatgaataatgttttatggcacaccacaaatattgacattctgtattttcatttccattcagttcaaggtactttctaatttctttatgattttttctttgatccaagggttatttagaagtctattttcggccgggcgcggtggctcacgcctgtaatcccagcactttgggaggccgaggcggggggatcacctgaggtcgggagttcgagaccagcctgaccaacatggagaaaccctgtctatactaaaactacaaaattagccaggcatggtgacgcatgcctgtaatcccaactactcgggaggctgaggccttgaaccgggaggcaaaagttgtggtgagccaatatcacaccattgcactccagtctgggcaacaaaagcaaaactccctctcaaaaaaaaaaaaaaaaatccaatgtgaaaatctctgccctttaattgcggtgcttagaccatttacatttttcatgagattatttaatggttaggtttaactcttatcatctatatactatatggattctatttgtctcatctcttttttactcctctttcttcttctttcttttggattaagtactttttattattccattatatattgattgttggttttttggctataactctttgaggctttattttagtgattgttttagagtatctttaaggtactcttagagcatctttgaattataaaagcctacctccaagtaatagaaaaatttacaaaaggtgttagaaccctagagcagtatacttccatctctttcctcccaactttcgtactatagttgtacatttagctttatgtatgctataacccccatattatcttattttttgtttaaacaacctattttcttctaaaatgagttaattaatgggaaaacatcatatatttacccatgtagttacaattctggtggtctttattccattgtgtagaaccacagtttgacctggcatcatattccatctgcctaaaacagtttaacattacgcagtgtagacctccttttattgtgcttgaaaaattatttatttcacttatatttttaaaaggtatgtggctggattttgaaatctaggttaatattcgtccttttctttcagtacttttaagatgttgcccctctgtctcatagcttagattgtttctgacaattaatcacactagtaactgttacatgtgtttttctgtacagaacatgtctttattctctggctgcttttaagatttttctctttatcactggtttgattaatctgattacattactgcctggtatagttttcttaatgtttcttatgcttggagttgatgaagtttcttgggggtttttttggggaggggtgttttgggaggtttgtagttttaggcaaaactggaagctttgcactattatttcttgaaatttttttctgtatttccacaacttccttcagggactctaattacacatatattaggccacttattgtcaccagctccctgatggtatgtttacttctctctctttctctgtttgcgtgtgtgtgtgcgtttcattttggatagcttttattgttatatttttaaggttactaatcatttcttatgcaatgcctaaagtgctgttcatagcttccagttacctttcatcttattcattgtagttttaatttctggaagttttatttagctcttttatctatcttccatgtcttagctttttgaacataaggaatataattataacagctttattgtacttgtctgctaatgctaatcttgtcacttctaggatggttttaatctataaattttcctcctataatggcttatgtttttctacttatttacataacaggtaattttttattgaatgctggatattgtgaatcctaccttttttggtgctaggtatttttgtattcctataaatattcttcagctttgatctgggttgcagttaagttatatggaaacacgttgatcctttcagatctcacctttaacatttgctgggcatgaccaaagcagtgctcagcctggggctaattatttcccaatacttaattaagagtcttatttatattctattcaatgcttgtggtcatagagttttccagtttggctggcaagaacagtcactattcccagatatatgtaagaaccaaggagtagtccatgtcattcctccttttttccagtctctttgtttactcacatgcatgagctgatctgtactcagtgctgcatactcaagagaacacctgcaggtctctggaattctctttatgtagctctctgctttctgtactttatcttgtgaattctagcctcctcaactcagggcctggggcaagtcctttgttttctatctctcagtgaccactctcctttattgcctgatgttccaggtcttaaaagctgttgtttcatgtatattctaagatttttgttgttgtttccattgggaggttaaatccagtctccatttccatctaggatgcactaacattttattttaaagaactacgaatgtcctatgtcaagaaaatacttggctacatggagccgtaaactaatcacagaactgtgagccatattacatattctgattcattttttgctacccttgttttgtgaaattaaatatattttatttttttctttgcttctatgctgataccaagaaaagaactcactatttaagtgttttaatgagaagctgtgaagtaaaatgaatgaatgatattaaagcaggggagtataataaataaaacattaaacaaggagtccaaaaacttacatgatataggacatataatgaactcaaattgaaggaatcactgaaaaacatatttagtgagttagtgtttaatttttaaattggtaactatttctgaaatgaagtattttgtataaaaccactagttcaccaagttttgaaaatcaattgggcaatatactttaaaagctatacacatgctgttacctttgacttgccaaatctccctttcacaacatacaaaaatattattttaaaagtagggataaaaaccaaatgcataaatattctatgcaatctaatttatggtagtgaataattaccgtgtgtcaaaatgttatatgtaatctttcaaaatgtttaaactatctctgagggtcacacagatgaggaattgaggctgagagtgtcataaaaagcaagtcagaggagatgttgagattcaaatctgttctgactctaagccctctgcctttagctcctagactacaactctagaaaaacagaattttgttaggataagtgggcatggatgtttttactcttaaccactcatattttaaatttccactactattatgatatattctctttttttgtaaattagaagaatatttttaaatgtccacaaaataatgtcactagataatctgagttaaaatttgtcccgaattttggcaaagaaaggaggatgggatgtaagtatatattgactctagaattcatgaatatcagaaaatcactacgtaagctctagcacaaaaaaactgaacggtttcctggggatacactagtcttcccttcaatagttgcttcagcagtttcctaatttatttaaaataaatcagcatgggactgtgtagaaatcaacagaaacaaggacttgacaagctcaaaaaatttcagagggaacaaaggagaagtcccttcagtacagagacttacatttctctttgtgaatatcctctttggggtacaaggcaaaagaactaaggtgatgttcatgctctcgacgttctttgataagtaacaaaagtaattatcttgcactagccattgctggcctgacaacagatatagtttcacctgttacaaaattttatttttttaaacgagttgtctgagtgacaaaaatccccctatttctaataagtgaaacttaattataaaaacttcaaagaaatagaagcctacttttgcagaggtagtcttcgtggagatggcaagaagactgtacaagggctctggactaacgtacgcccatcaagtaagcaataagcatcctcctcgcttgcaggacacctaaatttgactcagttccctgattccgccattttggaatacagaatttcagatgaggccaggtaacagctcaaatccaagtccaaatggagtcccactgacactattttcaatagacagctacatccttgcaaagcattaagagctgggcataaaatatccttagctgggattaacagcaaaacaatgcttggctgataacatatcttctttccttgtcagatcatttgttttcttttttgaaaatttatatttaagattgcccacttaagagagttggaataacacatattcttaatttctcaggctacttagggccaaatgaaatatttcttcaaggtgtaatggaaagccttcctggcctagtgctttcactcactagctgtgttacccaagacagtcaatgcaatatctctaaatgtcagtttcatcatatgttaaaatgggaaaaaaaatctctgcttcacagatacataaagcccttagcacagtgcctgaaacatatgaaatgctcttaataaactgttctgatataggagttttaaaaatatttaataatataggtcaagagccataaataacactggctgtgtatgtagtagaatcaattgatgaactttacaaaaaatacacacacatatgtatatacacatatacatatatatacatatatacacacacaaacatacatatatattcattgtatccacaggagatttctgaaatgattgaacagaatagggcctaaccataagtatcttttttaaagcttcttataaggagattccaatatccaaacagaatagagagctactggacataggttcttaaccggcggtccagaaactctttatagaatacagaaatccataaacttgggtgagaaaacatttagacttttatttttaccaatcttccaaactttggcatttttcaatcatgaatgtataaattaaaaataagggcccttggtccccaggtgagacagaatggactctttgtgttcaataagataccaaattataaaggagacctaacggcatgccaggcaaaggtaaaaacaagcacctctgcacttgaataaactgttctcagtgccacaaggatccttttttctttttctctggcagttaaacaagcactggcctcaagataagcaatataaaaacaattatagctcactgatcaccagatgctgaccgacttcccctcttccacagtcataactacagatttgattggacaagagatggattttagcaactttctcctaataagggactacaaaccatcgactggttctgcccagtttacagaggctgtgcactgagtgccttcatgtctctgcttcaccttttgatgtacacagcccaactgtaatacattcaaatgttaagtctccactgcaaagtgaacattgcatgtatataacatgcatgtttgttcagcacacatgcattaagaccccttcatgcatattcatagcttctcctataacctaatatgtaacttaaatgttaaggccccttcatgaatattcatagcttctcccataacctaatatgtaacttagatgttaaggtcccttcatgaatattcatagcttctcctataacctagtatgtatacttagccaaccccttcaccataaattcctgtctcacctttcttcccttgaagtttctgtctctggttttggccagaaacctgcttcctagcccacaggtagtaatattttctaagtattactcctttctaaatgtataaattgtctgattttttttttttttttggagattgagtttcactcctgtggcccaggctggagtgcagtggcataatctcggctcactgcaacctctgcctcctgggttcaagcagttctcctgcctcagcctcttgagtagctgggattacaggcacctgccaccatgcctgactaattttttgtatttttagtagagacggggtttcaccatgttggtcaggctggtcacaaactcctgacctcaagtgatctgcctgctttggcctcccaaagtgctgggattacaggcatgagccaccacacccagccaattgtctgatgtttttaagatgacaaatgcaataaaccatagtggcactattgatatctgtcactttggaccaaaagaaatcacagaaaatcacagtagagttgctgcagaaatctgaagtacttatactcaccacgacatcaaaatttgagtagttattagacccatcactagattgttacttagtgccttaataaaaaaaatacattactatatcgtatattttaagtgagatagtgagaatcctttgtaaccctatgaattttgttttatgccttcaaaaatattctggaaagaggctcccaagcttcgccagagtgcctaaggagtccctggtacacataaaatgttaagaactcaatatttagaggctatttgtcagtaaagcaccttcaggagtgctgatgtagatcaacttctttggaatcactttgaacccaatgtgtacaatgctgatctctcagtaattaaccgaggaagtgttttttacagaaatgaggtgtattgtaatagatgtatatttacatatcaattgttcttccttattaatttctctaacaaagccatcatttccttttctatcttcactacctgattcactgctgaagccctaccttctgcttcctactttaactgccacaaatgataaaaaatttcagtctttgcttcctaattcagtgcattcaaagtgcagcatgtattttttgttaaaaaaaattttccccggcccaaaatacatgattcataaggcgtttgcattgagaataaaaggattcactttaaactgacttctgcaagccctagttattctgcacatttaataataagcattacaaaatctcagcttaggaacaaaaagctcttagtcagtaataaattgtcactacaatgatcaatgtgccaaatttaattcacagataaataaaaggaaaccttgaaagccaagcagaagtctagtgtgaatgtaggctttggtataactgtgacaattcagagatgagccctcacaatatatttcagaggtctctctgcctttacattcaagaagttcatcagccatctcctctggttcatggtcaactggtgctcaccctctctggaaacagagacattagctactgatattagctgacctatgtccacacccagcacaattctttttatcagaaaagttagcttttgcttagaagctgccacagtgggttgaattgtccagtccctgtcattaaaggtggcagccatgcactcgagaatgatgtgaaaaaactccagcaagagtgataattaaacttggaaaatgaagggtcaccttctttcattcagctcattgggcaaacccatcagaataattccaaaacagcgggggactgtctactctcagcatggcaatatcgaggtgcacacacattatttctatgggttcaaatgggaatgccattttaatggtatttaaaacgttatcttcgatatgaggagtaaaaatgttagaaattagttctaggaatacagaaaaagaatgatgtgtataatctaaatagggaaagaatcagaaacaagaaaagtatgcatttttttctcaagaaaaagcattctaagagaagaaaattatctccagggaaactgaaaagaatattaactatgtctcttctttctactcaactgtagaatcacaaggcaagggtttcatctcagctttcttgtccacttactgtcatttcttggtggtcattattacaacaacttactcctacccaaaaaagagaaaaagtgtcacatgaagttaagacaatccattggtaggagttattttccaggaaaattttttttttcagacacattagcttatctagatactattgaatcagtatttgggaatttatatttcataccattctcatgttgcattaaaatgtaatactagaacagtggcttacacctgtaatcccagcactttgggaggctgaggtaggaggactgcttgagttcaggagttcaagaccagcctgggcaacatagcgagacatcatctctacaaaaaattaaacaattagccgggcatggtggcatgcacctgtaggccttaggaggcttaggcaggaggatcacttgaacctagaagctggaggctgcagcgagccatgatggcgccaatgtactctggcctgggcggggggacccatctctagttaaaaaaaaatgtaatactgaatatttaaggacaacataggcaaatgcactggatcagaacagaagcatggatggtaaaagcaaatttcaagttcaaattctagcttcaccatatattaggtgtgtaacgattgatatggtatttaatcgctgtgtgcctcagtttcctcatcagttaaatagagaaaataatactacctatcttataaagttgttcaaaaagatcaaatgagcttaaaataaataaaacttttgtaactgtgcctagcacagagtgagtgttatatcagtgctcataatatattataaccattattattatgttgcatgttcagtacctggcagagtatttaatactgtagatcaggtttacaaacatattatttctttttatagttgatcttttttttttttttagtccttatcattctgagaaaggcttcccaaaagatgtgggtcctttaataaacaaatagctcagcataattctcatatagagttaattatataatatgaaaacagggataattttcacatcaagctcaggaagagaaaaatttctaataagcagaaactatagattttagacgggtcacgatagttcccttcacatccaaacgactatcttgaggaagataaattatatttgtcctatgtgcatgtattttatttcaagttagtattttattttatttcacgtattttatttcaaatgcatgtattttatgtcaagttctatgtgcatgtattttatttcaagtttattttatttctatgtgcatgtattttatttcaaaattatcaagagataattttgaaataattagagctgtctaaaacagaaaaaaaacttgatgggcaaggcaatcatgtgatttctatattcctttgtaagaatttgcaatttatcagtttgtagacaaacatccaccaatttcaatagatttaaaaatatttatcattagtatatttaagtgttgtcttttgtctttgaaagacatatgtaggtaaaaaaatattttcgatgacataaacccacacattgcctcaaacctcaacctccattcactaacaattcattgaaagaaagaatgaaagaaagagaaataagttgtgtatatttgaaagagacagagaattgaggaggagggaggggaaaagagaggaaggatgagagagagaaagaggaagaaggagtaggaaaaaaataggaagtgggagagggaggtgggagggatagggacaataaatgaatgacattaaggatcaccctaatcagactattgaagagaaaatattatctattatattcaagcctgattttactgcaatatttaggcatggttctttaagagaaaaaaaagattttataaaagatagttgactaatttagtataggagtgttaaaattatttaataaattatttcccactgaaaaaatatagacttcataggaagatatgctgcttctgcctcaggtttatatttaaaatgatttatagtttacaatttcttcctaaggtcatcaccttcataaataccagccacatacagtgaaaaccaactcaataaaatgagtatttcatttctcttccttctgcttatgtagatacttcttccatcttacatggcacccatttataacaaagcttcacattgtgtgggtttttatgagttcttgagcttttctttcttttttatctttctatgcatcagcaaagcaactggcagattctttaataaaatatacacattaatatttataagcctatgaattggatgtttaaataaacattcaccaacttatgccaattctcttgttttagatgttaaatcacacttacgttgtctggaaagtcagcctttagttcagtgacactttgacaccaatatgcagccgttttctcactgatgagctcaatattcagaaaggagctttgtccagggccatacatggggccagaggtggttccccggatgattctgggggaaacatttgtcacaatgtcctgatgaaagagtaaagatattgagtctccttttgacaaagaaaagctataatctttattatctgctcatttccatatgacaatattttatgaggtcccttctcacatttttgcagaggaatttttaatatacattaaattagaattgaacataaactacttgcaaataaaaaggtaaaataaagtatttgttagctttagctaaattacttcttgtaattctaggtttagaatagcgcaaaaataaaaatatttatattcattaacactcatttagggcatactcattttaatttgtttgcaattaaataataaaaatatgataggtaaaatgcaaaagtttatcatttctgtctatttaatctaggtatctccaatcatagtttaactccaataagaattaatgttagtaaaaagtttatattttttttttctgaaaaaagtaactccgatgtaaatcagtgaaggaataatattagtattactggctcatcaaccattaacacacattctaataaactggttatgtgaaattacttataggattataactatatattcactttaaatgagaagaaagtcactttctccaagactgaaatgagtatatcaataacttcctgatacctataaacagtaaacagtaaaattaacttgcttgttaagtgtaattaacaatccacaactgcttctaaagctgtattaacgaagaagaataacattcttccattacttaaaactaaaaagaaacaaagaaggaaaatgtttcttttgccaacttccaattaaaattaattttgaggaaaggtcatttagttaaggatttatcagaattagtcatttaagtacccctcctcaccatcttgtcacttttagtaagataacatgaacccccattagtatatagcaattaaggtcaatttacatattttaattaagaaccaccccatataaaacaattagcgtaataggcatactaactggatttcataacatttggacgtttttccaactagatagacaggaaaccttaattagcattaattagtgctgatctgcatatgtttgataaggcatacccttgccacaaaagattatttattcctgaatctgccaaatgctacagttgcagaggataaaaggacttttcttcacattgcatgttaatttctggtaatttacattcacttttacatgcgaattagtatattataaaataaatggtataaatgttacaataagcctccttaaatatgtacattttaacttataggaatcatgccagttaattttttactaattaagccattccatttctattgtaattgtgtgcaacatcaccagccttgctttgatttgctattgtgaaaccatgtttcacaatcctaatgggtaaaatgacaaatagagttactccacgaagctcaagccttgtgggtcaatttccatcttggcaaacgcttaaatgtatgttctacgtccctacaggtggctctgtgaagctcatccagtgggtactccggtgttttcatggtctgagaaggcaattcttgaaatatttcactcagatgaggctggttttcttctgtgttccaattttcaagagccataccctttaaaccttgagatcctcctttcctctgctttactccctactctaaatgctcttcacctaagtaagtccaacctaggccacaagttgttctctacacaggatttcttagccaaggaggagtgaagtctgtatttagttcaccaagtcaagtgccctggtactgtgttggtgagcaaataatggggcatctggttttgatgaccattttttaattcattggtctggaaacaggtgcttcctgcttattcaacaaaactgattcacgttagcagcatccctactcccgcccattctccatatcttcacttagacttcagttcctttgagaagtttttcttttctctccaactccattgagtcttagtaacatgctctgactcatgccaccataacaatatataccttcctcaattggcattcttactaccatttattgtggttgtctatattcctgactgtaccttccactacagcataagacttgtaaagaaagaaactatattttgtttactattacatgcccagcttccagcctggcctttagtggtgctaaaataaagtactgtatcttcaatgagtctagactaaaaccataggcactagaataagtcttgtcctgaggtatgagaaccaaagacatttattgctggctgcattctgctgctgaacagaccagtggtttgggctttgatatagtttggatgtataccccacccaaatctcatgttgaaatgtaatcctctgtgttggaggtggggcctggtggaaatgattgattgcatcatgggggagaatttctcataaatggtttagtatcatcctcttggtactgtcctcatgataatgagtgagttcttgtaagatgtggccctttaaaagtgtgtagcatctctcccctctttctcttgctcctgatttgtcatatgatgtgactgctcccccttccccttctgccttgattggaagctttctgaggcctccacattagcagatgctgctatgcttcctatagagcctgcagaaccataagccaattaaacttatttttcttcataaatttcccaggctcaggtatgtctttatagcaaaaacgggcctttattcaaagttcaggatttattactatgcttagatcttttcctgctagtccatttgtctagaattgggttcttgcttgcttcttctgatccttcagggacccctttttctagaactcagtacaccccctcccttggatagatccctgaaccaaatgctgtgatacaaagcacccactgctataggccttctcacgcagcctactgtgatgactccctgacagaaagcatgcttgaacttcatctcactgcagcttctaagaccttcctggttgctagttcttaactgctgggtatcgctgatctctaggatttaaatagaatgcccccattcagatacaatacaactaccagtcttttttggttcatgtggatgtgtattcttaacctgatccatgaccacctagggtatttcctagctaatgagcctgtccaactacagttgtcttttatgtttgtcctgtatgctaagaacacatcttaacagtatacataggaatttttaaaatatcatagaatataaaagacacagaatggaaatttcacctataactaataaggaaaaaaatcttcatggttcaggaattctaagctatatgctatatgctatttacagtaacctactaataaccacaaagccaacatctcacattagccaaaaggatcaataagctgacaatatttaattggaagactgtcaagaaaatgcttctttcttaagcatttccctcatcagtaatacctcaaagcctacaattctacctttaagaattttttctttgtgtattatgagttaagtttcttgttaatgttggagctggtttatttttctcttctacgatgtggtgttaaactgtaaatatagcataggaaagttatgaatgatctccttaatcaagataatgaacaggaagtacaaaccaaatcaaaggaaaatttatttgctttatgatagagaatgcttattcctttgtgttgatttataatagagaatgtttatttaaacaggtcaattttctcattccttaattcaaccaaagataaaaggtcctttataacttctcaaattacagatgcctactgttgtagaatgggttaactatctgaaaggaatttgttagcatcatagaaattcaacattttccaaattcaactaaagtgcaaaattccaatgtattcatccagtaataaatcggtaataaaaattttattctagattttctttcccaaattgtcatgtttgctattgttttgccaaaaacattctccactgaattgagacttttagaatttttaaattaagtgaaagatgaatgaaaacacatatataaccaattatctttggttatataactagagttagagtttaaataattggacaataacttactaaagcttttgacctgggaagactagaatttgagcatgatttcataagagaatattttgctttaatatttaatggctaagtcttattagcattgcttaaaggagttaatataacaaaataaacatattcaagaatagttagagtagagaagagttcattctctataataaaaaagacaaactgccatagctctcatcttcagtgcattaacgatattcagatattttaaaaacagatgtttatagaaaaggaagtgttaggtaatatctttgctttatgtaatattataactaccattataacatcaagtattagtgaccttttaacatttgaagtgatgataatgattttttctctatcagaaaagagatttaaatggtaagcggactgattatatttgtttaggttcatttacttgacctctcttattataaaaacttatgatgtttctatggttactactgaattaaaacagtcacaatggccacaatgaacacaaaaagaaaactttgcagaaatgtctgagtaagaggctagaaaaagaatggggtcaaacaaagttggatgaaaacaagaaataaaatttgcaaagtgaatcatggctacatataccatagtggatgaattttataaacatcttgttgaatgaaaagggcaagttctagaaaaatatatagaatatgacacacaacacaaagcaatatattatttagtgaaacatactgacaggataaaactataaatataagtaaggtaacaactaaaaataattcaagatagaagttacctcttggagtaggtagatgctggaggagaaattggaaatggtagagcaaggagggctttctgaaagtactagtgatatataattataaagaagctttactcttgaactgcagaaatgtggcagaatgagaaatctgttcaatgagttatgcagtagtatagtgtatatcgctatgagttgttgataaggttttatcagtttacttgaaaacctgtaactgaaatcgaagaaacatttgttttgttttcttaacttccaagattctgctgtaaatattttgtcaaaaatgttttaattatttggttttacaaactaggagttcaaaaattaaatgtacttcatgaccaactgtttcctaaaatatatcactttcctaataaaatcctactgagataagtacaacataaccatacattatttcacaaaagaggaaaatcactctacaaacaagtctaacaacaaatatcttgttacagagtcagattccatcattataaatctaacatactgataccctgtgaatagctaaaagtgaaataaaattcaagagtggcccagtttctagaacaattgcgctactatgaaagaactcactaacattttattttcttcatgaactaagtatattaatatttgattcctccacaaaataaactttataatggtcagaatactctctacttggttttcttggaggtgcaaagtgggcaagataagtatttgttcccaataaatcatatttttctcttgtagtagcttatataacgacagtactcaatatctgaattagtgacagaatttgcccttttgtcatcaggaacttcagacctatctacatggaaaacacaataagcaaaaatagcactattatcctagaaataaaagataaattatcagagaagttgtagcactgacattgtagaaataataatattttagatatgtatagcacaaatctgtcacatatatcagtcttttcaaattatcatgacctatatccatggttgcatatctagtaagcattcgagatgagactagaactcaggtgtgcttatgtgatatggataataataatgttgttagtgacctcttaacatttaatatatgtaataataattagaactcatttcagttgcaagaaaaacaaatcaacttgaataagttaaatttttaaaaaatggggtgttgtctatttattttaaggaaaaggagtatttcacataacacacacaaatatgcaactatacctcagctaggaatcattctgtgtctcctctctgcttctgttggcttatctcttcatttttctttctgtctctccacagagggctttctctgtctcagttcatatgatagaatatagctctctgacaagtcccaagtctacaagttgtagggaaagacactcctccaaacttgtaatctcttaggccagattttaacccctggtgacagaggccctaacgggcttaagctgcattagttagtcatcccttgtttaatgaactatgtctggcaggataaaattaattaggattcacacagatgctcaggtaaacaatgatggcgtaattgagagctgggcaactagtattataggaatctgtgacaccaggaccagtagatttaaattcaccttagaaactttagaagaaaatatacaggcatgataaaggataattatctaggaaaatggggtaagacaggcaaaataattatcatttagtgaaataaaaactctccatagtcttgaatcaaacatgatggtccatttcctattcctgtggcccaaaaccttgcaagatcaaaattctaagaatgctttgacattctccagtgttttagactacactgggactctctcattatcatgtgttagtgtgttgaagactgtcaacacaacatggcacggtgtgtacttaatctcagtcttggcctaggctgaactgatggaatggatagatactctacgtaagcagggaagacagtggaagaagtaggtaaggaagaacaaagaagagcacattgttctaaaatgaataagaaaaaatgtacgacctgattaggcttaaaagacgggaataataaatgaaaactgaccagactgaatgtctgctatatgccaaggaaggagttttactcacatattctccagtgctcacccaacaccaaatgttcctcacctcttggatagtgtgtcacatatataaagcatgtggtgtcttataccacagaaatatggagattaattttctgaattttatttatgtctgactgataaaaatactggctcacataatcatgtagccttttgtttttcctcttgccctttttcaaagagcttatgattttgtaaactagacactaaaagtggtttgttttgttttttgaccttctcatctgccgatccggataaccatcactctgtcacagagaagttgtaggatagtaaatgaagcaatacagcacatgactggcatgtggtatttgataaataaatgtttattcattcaccaactcactaggcttcagaaacagtcaaaacaaaagttgtgggagttcaggtgactggctttaactagttcacggctaaagctgggaaataaaccggaaatgaggatgggaggattaaatagagttgggtcagattgcagagtcctgaatgactgttttaaggagttcaaactttttctgcaggctttgagaatccattgtgttctgtctcctattcaagttattaataccaatagctcacagcagctgtgcattcacggagataagttttacaagaaacagatgaagggcttttttagtgctgatatcagatggattagaacgtgattaatcaacagacagactgattaaattattgggttcactgttcagataagaggttttggatacactctgccaaacggtaattaacttagaaatttctgctggcctgcttataagatgatcatgtgatatgctttgaagaaatcttttaaggcccagaatagcagctgtgaaggtgtaagcatgagtcagttttaacaattattaattatcttcaagtattagagcagaattttcattggaagtgataaatattttttaaaatctttacttttaagaaaacttgtgtaaatctctggctctactctacagtcgactgcaaatgaaatgactactatttaaaggagtatctaaaagagtcaagagaggagttttccatttctacaacatggttaacaagatattgaaaggaatcccttgcaatataacacatataaacctactggacaggatatgattttttctaaaagatgcatagctgtactggtatcaaaataaggaaatttctgagagatcagaaataagcacgaagcagagattcacaagggcaaactaactattgggtggtgtttaccctcaaggttttcgcccatccctggtggcctataaactgagttacaaacatctgagacagcagacaaagtctgggactgagcacgttgttaggtagagtagaaatcgccacataaatataggaccaagaaagagtgatgctctcactagaaaataactagagagcaatggcgggtcatgcgtcagtttcagctttagcaatcaaggaggtaagtctcttctaagaatcttaacctgtgtgagccccaaaatttaaactgcgaggttaaaaatttggtttaaaagtggttcctagtcatggtgtccttagataactagtaaaagcaatctcagaccctctctgaaagaatttactttacctcaaatatttataaattcccataaatacattttcaaggaatgtgagcccacaagagaagaaaatcactaatgacatgagaaaaaagatatcataggtgggagccagtgcaaagaaaaagctacaaaatcagatctaccaaaaaatgtatataatgggattatcagatgtaaaatataaaaaaattaatatgcttaaaaatacgagagacttgaatgtataaataatgagaaactcaaagtttatcatgaagatataacatatgagcaaatagaatttctagaaataaaaaaaataatatggaaaattaaaacctaatggtttggggatgatatgatgatatatctgggcaagttacctgaaagcaaacaaatgtgatgcaaaacatgatctagaggttaagagacatggagaatagcttaacaaggtaaaggaaaaatcaaattgcagttcacaagaagcaaatggagagaactaggagaggcaccatttccaaagatattgtcaggggtttaatagaattgatgaaggacaccaattcttagattccagacaacaacaaactgaggaaaatacgttttttaaagaattgatatctagatacattgtagtatacaagaaagggaagaattaaaaaataaccagaggaaaaaaagactactcacaaaaataaaaagcagattgagagctcacttcttggcagtaccaatgaaagccagaagagattagaatattttatatgaataagaaatgttaactgagaattgcataccttgtagacttataactcaaggataaagaaaaaatgaagacatttccaacaaaaggaattgtgagcaaatagtatatggtagagaaaattaatgaactaatgctaattctgcaactaggattgatgtgaaaaaacaaaatattgaacaataacaagaaaaaagcaagctgtgtaaaaatataaaggtgtgattatgtttatatgaggcaaaaaaataaacaaaactaaatagtacactgtttagaaatacattatgtgaaaaacatacgcaaaagcaagaaaatgattatcataaaatctaaaatagtcacctttcgagggaggagaaaggaatataattgaggaggcacaaacagaatcaaaggtacaggaatatcttatgttctcttcttctgtgaaatgagaaaaaggtattcatttttactatatcttaaactatataatttttgtagtatgcaatttttatagtaaaaaatgaaaacaaacttattaagcagaaaaaaagcaggtgcaaatctgaagataacagtgtttgataactctaagattgtatgttttgcctcagtattactgcctctgttgtcatatggttctgaatgatgttttagaaagaatattgattctagtcattccactaacaaaatgatgagcttgagcttgtattacatgatcctttgggattacagatcccttggtggatccctaatctaccactgatgaggatttcagtcatttatctatacaactacaaaacatacaacatgggaacatttcagattggagatactgctatctgaaacccttggcacaaatttatgatttagaggcattggggctcaaaaaaacgacaccctgaagtatggtgcgttgatatgctgagtactttgaactaaaggaatagcctcagaaccaaggtctctctggccttctcccagcccccatctcttgttctttctttcctgaagtgcagggagaggccttctcagaagtttcttttatctgactaaaggaaattcttcctgaagaaatgtcattgtcctgaactccttccctggaatctacattaaccagtcaagattaactccttgcaaaagaagagacacggccaggcacggtggctcatgcctgtaatcccagcactttgggagaccaaggtgggcggatcacccgaggtcgggagttcaagaccagcctgaccaacagggagaaaccctgtctctactaaagtacaaaatcagccaggcatggtggcaggcccctgtaatcccagctactcgggaggctgaggcaggagaatcacttgaacccggggggtggaggttgcagtgagctaagatcgcgccattgcactctagcctgggcaacaaaagtgaaactccatctgaaaaaaaaaaaaaaagaaagaagcgatcacacttacacttttcacctattcttaaggctactacctgggacactttatctgcatataaggcaacctttgttttcagttcagttccttctttcacccttctattgcttgtgctgccacctcccctcagaagccccaatcccctacttcattctgtagctcaaaatattatttatgcttccacaatttggcactccttagagtctcatattttgtgggacttccgtatatatgaagttgataaatttgtatgccctttctcctgttaaatctgtctactttcaactttattctagagattccaatcataaaaactttggaaaacagagggaaagcataaaacttccctatagaggtaatttcaaactcatattaaagtcatttcgggcaacacacacctctgttttggctaccttagggaaccttcctcaccaatatcctactgactaaaatggaaagaaaaaaatgaggaggataaaaagtttgtttctgccaagaatctatgaaactattcagctaatgaaaaatcatttatttgagcatacatacaaagtcaaactaccctaaatataagataagcagctatgcgatataataattaaaataataaaatttgaagtctgttttctcatcattctactcaatagcattctttcatatattaggccataaagatgcttgtattataattacaaaacaccattaaaaaatgtattatgtcctacagcacttagccttaacaaacaattactggatctcacattcaactgaatacaaaaagcaatctttatcacaaggttaaaattagccttggaacaataaatgctttcaaagctattctaaactccaaactgctttgcaccagtctgttttgaggaactgaaaacaagtaaactgaaggacatttgaaaaacttcctgtctgtgtcctctcaattttttttttgtttgtttcataggagacaatcatgttatacctgaaaggtgatccatatggccctcacagggtaaggtttcagaagttaaaatcaaaaccaaacaaaaataattaaccaagtaaacaaagaaaccctgagaattctagatttcacaatgtgttattcataatagcactctaattatcagcactacttttcagccattactacagaaaaaaatgaataaatttgattcacggaggagggacctgaaagcaaatggatttgttagttagttcaaacccagaattctgagataatacacttctcagttcatccttcagaagacaatatgatatgtagaatttcatcatttaaattacttaacaaattaatcagagtagcttctccttctgtaaaaggtgttgtaaactaaaaataaaattctaagccccccaatcatatgaataggccccctcctctcagtcaagggcattgcaaagttaacctgaaaaactagttcagaccatgatgggaaggtggggctggacatgcctcattctaccctcctccttttgaaattcaggcataactgtaggtattaacattaaaacagagatcttaagactgatgaaacaaactttttgtgcaataagacaccaaattccagcctcactctagtacagcatcacataacaggctctgaaaggaattgaagtattttaccctaaactatatttctttaacatattttgaaatggtcctgcaaagttgtctcttgtggggaaaatctactttctgtagagaatccccttccttttccaggtcttttccctgatctaggagagaattaactaagagtctggcatatttttaagtctgacaaggaacatttacaatctattctctctgtagcctgctacctggaggcttcatctgcataataagaatcttggtctccataatcccttatcttaacccagaaactcccttctattgattccaagtcttcagataaactctttcaaccaacttccaattggaaaatctctgaatctatgacttggaaccctcccctgcttcaagttgtcctgcctttctggaccaaaccaatgtatatcttgcatgtaatgattgatgtcttatgtctccctaaaatgtgttgatataatttggctgtgtcttcacccaaatctcatcttgaattctcgaatgttgagggagggacccggtgggagataacagaatcatggggcaagtctttcctgtgatgttctcatgatagtgaataagtctcaagagatctgatggttttataaagaggagtttccctgcactctctctttgcctgctgccatccatgtaagatgtgactttgtcctccttgccttctgccatgattgtgaggcctctctagccatgtgaaactgtaagtacattaaacctcattattttgtaaattgcccagtcttgggtgtgtatttattagcagcatgtaatggactaatacagtaaattggtaccagtagagtggggtgctgctgaaaagacacctaaaaatgtggaagtgactatgaaactggatagcaggcagaggctggaacagtttggagagctcagaaaaaggaaaatgtaggaaagtttggaactccctagtgacttgttgaatagctttgacaaaaatgctgataatgataagggcaatgaaattcaggctgagatggtctcagatggagatgaggaacttgttgggaactacaggaaaggtgacttttgttgttttagcaaagagactggcagcattttgcccctgccctagagatctgtggaactctgaacttgagagagatgatttagggtatctggcagaagaaagttctaagcagcaaagcattcaagaggtgacttgggtggtgttaaaggcactcagttttaaaagaaaaacagagcataaaagcttagaaaattttcaacctagctgggcatggtggctcatgcctgtaacaccagcactttgggaggctgtggtgggcagatcacttgaggtcaggagttcaagaccagcctggtcaacatggtgacaccctgtctctactaaaaatacaaaaaatagctggatgtagtggtaggtgcctgtaatcacagctactcaggaggctgaggcaggagaatcacttgaacctgggaggcggaggttgcagtgagctgagattgcaccactgcactccagcctgggcaacagagcaagactctgtctcaaaataaaataaaataaaataaaataaaataaaataaaataaaataaagaaaagaaaattttcaacctggcaatgagataaaaaagaaaatcccgttttctgaggagaaattcaagctgactgcagaaatttgcataagtaacgaggagccaaatgctaatcccaaagacaactgaaaaaatgcctccagggcatgtcagagacctatgtggcagcctctcctatcacaggctcagaggtttaggaggaaaaaatggtttcatgggccaggtccagggtccctctgctgtgtgcagtctagggacttggtgtcgtgtcctgtgccccagcaaccccagccatgactaaaatgggccaaggaacagctcaggctgttgcttcagagcgtggaagcctcaggccttggcagcttccacataatgttgagcctgcaggtgcacagaaatcaaaaatcgaggtttgggaaactttgcctagatttcagaggatgtatggaaatgcttggatgcccagggcagcaaaagtttgctgcagggacgggaccctcatggagaacctctactagggcagtgcagaagggaaatgtgacatcagtgccctagagtccctactagggcactgcctagtggagctgtgagaagagggccaccatcctccagaccccagaatggtagatcctccgacagcttgcaccatgcacctggaaaagctgcagacactcaacaccagaccatgaacacagccaggaggagggctataccctgcaaagccacaggatggagctggtgaaggccatgaaagcccacctcttgcatcagcatgacctggatgtcggacatgcagtcaaaggagatcattttggaactttttaagatttgactgccctgctggatttcagacttgcttggagtctgtagtccctttgttttggtcaatttcttccatttggaatggctgtatttacccagtgtctctaccctcattttatctaggaagtaactaactttcttttgattttacagcctcataggtggaagtaacttgccttgtattggatgagactttggactgtggaagtttgagttaatgctgaaatgagttaagattctgggggactgttgggaaggtatgattggttttgaaatgtgaggacatgaaatttgggaggggcaagggctggaatgatatggtttggctgtgtctccacccaaatctcatcttgaattcccatgtgttgtgggagggaccctgtgggaggtaaatgaatcacgggggtaagtctttcctgtggtgttctcatgacagtgaataaatctcatgagatctgatggttttataaaaggagtttttctgcacaagctctctctttctttgcctgctgtcatccacgtaagtaagacgtgacttgctcctccttgccttctgctatgattgtgaagcctccccagatatatggaattgtaagtccattaaacttctttcttttgtaaatggcctagtcccgggtatgtctttattagcagcataaaaatggactaatacatgtgtaaaaccaagctgtagctcgattatcttgggcacaagtcgtcaagccctactgaggctgtgtcatgggcaggctcttaacctcaccaaaataaacttctaaattcattgagctcaggagttcaagaccagcctggacaatgtggggaaaccttgtctctacaaaaattagctgagcatggtgatacatgcctgcagtcccagctacttgggcggctgaggtggcaggatggcttgagcctgggaggaagaggccgcagtaagctatgattgcaccactgcactccagcctggatgacatggagagaccctgtttttaaataaatacataaattgattgagacatgtctcacatacactctggtttacagtgtaatcaaaattataacaaaaaaagttggcaaatagaaaatctggatatatacgcaaaatattcttatttgttgacctaaaaataaattgattcctgcagaaggttctacaatcaaaatcttcctatcactttggttaaaatactgattgagaccctatcactagcttgctgaagtagctttgcaaatcattagatggttataaggaacatcatcatggtggcagttttcttttcggctgtaatcacagtctgacttcacgtgtatattcaaaattaattaagtagcaacagtaacaacgacaacaaatacattttaagtaacaatcgagtcagtcacttagatgcctgtctcggtgtcaagattgataaaagcatctccaaatgatagctgatatttttatagtgctctataattatcatttgtgcttttaaacatgcaataaaatttaacattctgaaacatcctatgaaatgagagaacctttttcaaaaatgttctttgaaatatttggggctaaatgggaagttatgtgaccacgctattttggggaaacaccaaagagacctccttctggtgattcacaaggcatctaagcatattaaaggccaccaggcatccagtactaaacctacctgcctaattttctataatccattatctttcaaaccttttggattctaaaagtttttcatatattacccataaatataccaaagaactctaacattttacagaaaacaggttattgagatagagaaagaaccccctttaggggcctgcagtggggggtggagggtgggagcccaagcatggaaataaaggaaaaacttgagatcctacaagaaaaattccaggcacctagctagccttgagaagtaaataagcaaattgataagcaagaaggtaacagtagcttaaaacaatagccaaggaagctataatcacaggatgtttcgttctctcatagaaactaacgataaaatatgtctctaagttgtttttcggaaatctgtacctccaccgaatggatctgcctgcaagcaggcctcagataagggagaactaagggctgaactttgaccaaagttctttgttctgcatttctttctgaggtacctagagaaagtcaaacccaagagccagagctaacattctttttgctcaccacaaatttcaaaacaaagcttctcttccttaactgattgcaaatcagaaaacatctgaatctacctatgaactgtaagccccctgcttcatgatatcctgcccttttaggccaaaaccaatgtgaaacctccatgtattgatttacaattttgcctgtaacttctgctttcctgaaatttacccctgctttaaaaaatcctcatctgtaagccatcagggaggtcaggatttaaatgtgagttgcctgatcttctttgcttggtgccctgcaataaatgcttcactctctctcgctgctatcaggttgtcagtgtttgtccttgctgagccaggtgagcaggcttctgatgtatttacgtaggtcaatggtctctaaaattatttgatcatgtactccatcaacaaagcaaacttttgacctgcatctccaatagaacatttagaaaaatagaaatcagaataaaagagacaaataatataaatattttcaaactttcttgccatatcccaatgctttagggatatctgaacccacaatgggcactgaacaagatttttctggagtgcaaaagaagggaacagatctagaaaagaagctatttagtttggtgcaacctcataaaaatctgccctgacaagagaagactgtccagagcaggggttgacaaactcctatggtaaagagtcagatgataaatattttagagtttacaggcactataatctctgtcacaactattcagctctgctattgtcacaggaaggtagtcatagacaacattactgagtgagtgtgtctatgttccaataaaaaattatttatggacactaaaatttgacttccatatgtatatatgtattaatcagttgttgctttcttactgctacttacattaatttcatactattttcaaatgtaacaaatcttctaatttatttccagccatttatactatggtctgaatgtttttgtcccttcaaaattcatattttaaaatttaattatcaatgtgatagttttagaaggtgggcattttagaggtaattaggtcatgagggtggggtcctcatggatcagattagtgcccttatagaagagacccctagagagaccccttgtcctttccatcatgtgaggacacaggtagagggcatcatctatgttaacagaaagtgtgccttcaccagacaccaaatttgccagtgcgttaaacttagacttctcaacctccagaactgtgagaaacaaatctgttgtttagaatctaacccatctatgacattttgttatagcagcccaaatggactaaggcaatttacaaatgtaaaaatcattcttaactcataggcagtacagaaacaggtgggaggctggatttgacccacggggctatcatttgcagactccttgtcctaagaatgaaggagtagattaaagaggaagaccaaagatgactacagagggtgagctgaaacaccgttttgattttcctgctaagttttaaggatgaaggatgaatgattcagtttcttaaggttaggagggcataagtcttgaatttatttataataagtagcagtaagaaatcagcagctagccaatgcataataatggattccaaaaaaattagtttccttgaaagagttcaaaacattatttaaaacatgattgcacttttgacaagtttttaggaaactccaaaattatcagagctggctctgtgatcctaatggccctctgtagatagtcaccactaatgtttatcagcaggaattatttctgcaaaaatggtatgaaaggaacagccatttaatatatccagctcattaggaacaaatatagtcctaatatctgtaatgtttgatagcactagatataattattttcaaatttaggtgagggttacacaaacatcataggtctccagaagccttttatctgataaatctaagtgcaataaaacctcatggctctgataaccaaaggctaaagaatgagtgatttatatacactgcagccttccagaattccaacttgttagctaaaatagctctaagggaagctaaaattgcaaaaaaaaaaaaaaaaaaaaaaaaaaaaaaagacaaataaataaaatgccagtatttcctcagaaacctttttggttgtagttgattttttaaaaaacagttctaatattactgaattttctggtagtgaaaatagaacaataggtataagcatcactgtttcatattagctatacagaagagtatgttgaaattcattcattagcatattgataagtttctgcttctctgataaaattaaactatactaaaggttcacaacttagaatgtagatactaaccataacaccatattatgatcttataattgggttacgatgtcttggatcaattttgtaatggaagtaatttcaaagtaatcttatttttttaaattgctacaaatctaatatacagagaaatgtgaaagattccaggtatctgaacaactggaagcaaagtatctgattgtttacttagataacatggaggatacaggctagagaaaaatacttaaatgattgtgtattcacatggaaaagtgttcctaatatataaaagccctcagccaggtcattttcatcgttcttgcaaataacaaatggatagctaaatagacttgaatatagacataagcagatcatatttgctaaatgtgttgatgttattgagaggaattaggaggtgctccaatggactgagggaccagattaagagatacaggtatatattgattctcataaacttcatacattccccctgcatttttcgaatcatttttttgatatgatggggcagtatggtgtattgtttaaaagagaatgaagtcaaattagctgtttcacatactgattcttttattttactatctgtgccacccagacaagtaaacagcctctttctatttcactttcctcattagtaaaatgaagatagtcagagataacatctcaaaaattaattgacacagccattaaataaggtaaaataaaaaagtgtatttagtttggataaggtaaaataaaggatgtttaaagtgcttaaaataatgtgtggcacaatacaaatgattattatgatttcgtggtcttccatgaattaacatttttaccctctctatggaagtaatatgtgcaatataatactgatgtatactttatctttggtgaatggatgctgggtgtttcagaggttgtatatagctgtaagcagtataactgcacgaggatactgggagaactttgatctttaggagggcttccaaatgctaacttgctgaagctgcccatgttagtgatacagttagacctacaaaagaattataagatttctgaactagggccaggcacagtggctcatgcctataatcccaacactttgggaggccaagacaggcagatcacctgaggtcaggagttcgagaccagcttggccaacatagcgaaaccccatcaagtacaaaaattagcagggcgtggtggtgggaacctgtaatcccagctactcagggggctgaggcaggagaatagcttgaacccaggaggcggagattgtagtgagctgagatcgcatcactgcactccagcctgggcaacaagagcaagacttcatctcaaaaaaaaaaaggtttctgaattagttatccacactgcttgatctggtaatgggaaaggatttgagctggagattgtgagtgcagaatgcagaacaacaatgcagaacaggtctaggccatacatcttttctgaaaacgtaatgtaagaacagagccttatatgcctacttcactgatgccattatgtataatgagatcaaacaagtttccctctaagtttcatatttcattgtctttaacttcaatatgttttaaaggggtcaatagggaaattataaaaacaaagatgggggtcccaggacagggaataaaaaaaacccgaaaaacaaaaacaaagagtccgggaaggagaccaaatatcttggatacagaatcaagatccaaaaagatgttgtgatggaccagagcaatggacttactttaacaaattaacatgtaacttggggtctaaaactgcaaccacacaactacaagatagagacagtagagtttatcagctgaaaacattaataaaacaccatggagcttatatttcaatatagtcaagacagaaatgagtattttcacagtaaattagtatgggatgtgatcgtcccactttccttttttttttttttgagacagttttgctctgtcgcccaggctggagagcagtggcacaatcttggctcactgtaacctcagcctgccgggtccaagcgattctcctgccacagcctcccgaggtagctgggattacaggcgcccaccaccatgcccagctaatttttgtatttttagtagggactgggtttcaccatgttggccaccctggtctcaaactcctgggctcaggtgatctgcacatctcggcctcccaaagtgctgggattacaggcgtgagccaccacgcccatcccgtccccctctttttcagagatgtttgaagtagtgccttcagtttttggcaaactagaaaactttaagtggaaaatgtaaaaaaagagacaggtttagagacttaaagacaggtcatatgagaaacagttaaaagaaacaagcatatttagcttggataaggaaaagagtcatacaaaaaatctatttttacttatctgaagaacagtcatagagagggagtttaaatttttctgaatcaccttaagatgggataatgtgcacaataattagaaactactcgaaagcatttcaattgtactttcaaacatccaaagctatttaaagaggcaattgccagtctctgaagagttcctcttaactaaagggtttgaggatagtgtagtagacacctactggattaactacccagcactccttttctgagaattgcctgttctctccttcacccacctggttgcagcctctgtcacaccttcatctcccctatgcacatcacttttgataggttcagaggcaacaacctgagaaagagtccatacatggttccaatttttagtacactttcttccttaggcaagttgctttactgttatttggatgtgagggacacctccgtatatttttcacttggatttcagttgtgcaaccaaaacaaaacttatatacatattagccagggcactaattgacagcaaattggggaatacagtaagcagatgatggccagtaagcctgtaagttcacttccaactgatactttgtatttgtgtgactactcacttttagtaaacatctatctttaaggacaagctttgggaatttgattataaaaccataaccttttctcaaattatattaacctaaatagccataatgagagaaaaatataggataaaatgttcccctaattatttactgaatttttaattgattttccagctttattgaggaataactggcaaaacttgtatatatttaagatatgcaatgtgatgacttcatatatcaaacattgtgaaatgattactataatcaacctaactgacacagccatcacctcacatagttgcctttgtttttttgtggtgagaatatttatgatctactccttttacaaatttcaaaaatacaatatatgccattatagtcaccatcctgtatattagatccccagaacatattcatcttaaaattgtaagtgtgtaccctttaatcaacatcttccaatttccaacctgcttcccaaaatctcctggcaactaccatcttactctctgcttctacaagttcaattcttttaaattccacaaagaagtcagatcatacaatacagtagtacttgtctttctatgtctggcttatttcacttagcataatgtcttctaggttcatccatgttgccccaaatgtcaggatttccttcttttatggcagaataatattccatgtgtaggcatacataccacattttctttttttattcattcatcaatggacacttaggttgtttttctatattggctattgtgaataatactgcagtcaacatgggagtgcaggtatctctttaaaaatggtcaaatgactcgaatagagattcttccaaagaagattcacaaagagccaaaaagtatatgaagaggtgctcaatagttccaatcaccaggggaatgcaatcaaagtcacaatgagctatcaccccacaccaatttggatggctagtatcaaaaagtcaagggacaacaagtattggtgaaggtgtggagaaaagggaatcctcatacactattggcagtaatataaactggtatagctattattgaaaacagtatgtgccaggcacagtggctcacacttgtaatcccaacaatttgagaggccagggtgggcggattgcttgagcccagtagtttgagaccagcctgggcaacatggcaaaaccccatctctacaaaaaacatagaaaaaaacttagctgggcatggtggaatatgcctgtagtcccagctacttgggaggctgaggtgggaggatcacttgagcccaggaagttgaggcttcagcgagccatgatcatgccactcactgcactcctgcctgggcaacagagtgagaaactgtctttaaaaaaaaaaaaaaaaggaaagaaaatgaaaaagaaaacacagtataaaagtttctcaaaaaattaaaaataggttaccgtatgatccagcaattttatttctgggtgtatatcaaaagagaatgaaatcatttactgaatttaaaaaagaagttaaatacttatgcaaggtaatcaaaatgacacaaagtctacaataaaatattctaacgatgaacaatgttgtttaccagaaatgcaattaatttgtattctaaatgtaaatataaatattaacacaatgaaatgtaaatgccaatatagcccattatacatactctgagtgtctaactaaacatatgaaaacataccaaagatatatttacaattagatacagatcaggtgttctgtcagacatatttcacatttaaaatttctggggaatgtctttaataatgtttaaatatttaaaatcctttgaaaagagagtttaggtattaaatcaacttaatacagacttacagattaatattactcctagtaattatatattagatgttctgaatatacttattaataattcatttaataacaacttaaggttcagtttttctgtcacagtttaagattaataaagaaacaaaaaataaatgataaacacagaagctatgtgttatttctatttaagaacaaacttgtggtggcatataatgtagaaaatgcatgtagatatttaattttggcattttgaatattcttcccaattttatttaatctgaatgagatatatgttataattatagcaaatgtttgatctaacttttatatagaattctataattaataaaatgcaattcagacataaactcctatcattgacttttggaattatgaaaaaataattccaacttttatctataaaaattatatcttatatctatgaaagttgctagaaaagttaagaaaatgtaaaaagaagaacacaggtcaataatatatgagaaaatgtaataaaggttaataatatgtattagcacacgtaataaaaatcagtaatttaaacagtatggttatgttacaagaagaaactgtaagaccaatggagcaaaacagcagggcaatgattgcggcatcatttttgtgggcattcattcatgtttgaatctgatatatagttaggctataatattaaattaatggggaaatatgagttattcatcaattgacataggataattgataatttagtgaaaaacaaagttaaatcatgatgatttgctatataccaaaataaactctagatatattaaaaacatatagataaaacagaagaagtagaagaaaacatatgttaacacatgcctcaactttaaatgttggaaaacttttaagtataaaaacagtgacaataaatgaataaataaatgacttaataaataagtaaaggaacaaattaatgagtaaaagaaaaatagactaaataaaaattcaaaatagagctagcatggattaatgttcttgatatattgggagaaaaggattaacggctgagttgtggcctttcctctagccctggggtagccaaattttatttgtaaagagccatttagcaaatacttactctttgtggatctgtctgtcacatctactctgcaactgtaacatgaaatctgccatagacaatataaaccaatgggtatggctatgttccagtaaggctttattttcaaaactaggctggtggccaaatttggcctgtgcaccttggtttgctgacccctgctctagcctcagagatgtgaaagacttgacttttggcctaatcctccttggcctaatcctccttgcaacaataactcaaaaagttaatacctgatccaagataaatcagagtcctgctgaggttacactctactcactggatacctatacattgttgagtttgattattaagtaatctataactaaggagatacagttacatcagaaaattaaagctagattcctaaccctgaggggagtcatgggctagcaaggtaacaaagagtaaatagatcccagagccgatggtttccctaaactgacagactacatcaatcagtccctttcctagtgaccatggaagtctatggtgcagaatcatctggggacactgaaagtggtgccagagccacatcactttcactttattaatactgtacctgctgtaacagattcatctcagatcctttttaaagacaaataaacttgatgctacatttctgggttggactatcaatcaaaatccaaaaataactgctgctgggaagagtaaaatatatgtgtgattataaaatgtgttcaaaaccaatgagaaaaagatgacccctttagtagaaaatgataaaaaatatgaacaattcacaaagtataaatttatatgaaaaaacaaagcaatgaaaaatgtttttaccttgttagtaatcagagataaaatgatccaattttatacttatcaagtcagaatttaatgataaaactatgcactggtagcagcataaagaaataagaatctttgtgaactgttagtagaatttacactggaaaacttgaaagtaattaggcaataggaagtaccacaaaatgtactttttgaactacaatcccagttctaggaatttatttcataaataagtcatagaacgtataaagatatgtgcacacagataccatgtttagcattatcgcaacaaaaatactaaaaaaaaaacagcttatatgtcaactacaggcacacctaggagatgctgcaggttcagttccagaccatcacaatcaagtgaatattgcaataaagtgaatcacacaattattttttgtttcccagtgtataaaatatatacactatgctgtattaagtgtgtaatagcattaggtctaaaaaatgtacattctttaatttaaacattctttattgctaaaaactgctaatgatcatctgagccttctgagagtcaaaacctttctgctggtggaaagtctggctttgatgttgctggctgcttactgatcaggatggtggttgctgaaggttagggtgcctggcaatttctgtaaacaagacaacaatgaaatttgctgtatcacttggctctttatttcacaaaagatttctgtgtaacatgcaatgctatttggatagcattttacccacagtagaacttcagtcaatattggagtcaacatttcaacaatgttcacagcatcttcactaggagctgattctatctcaataaactactttctttgctcatccataagaagcaattcctcatccatccatgttttatcatgagattgcaggaattaagtcacatctttaggcttcacttctaattctagttatcttgctatttctaacatatcttcagttactccctccaccaaagttttgaacttcacttgaactcagtgagagatatgcaactctgcctttcccttgaatacttagaggctactgtagggttattaattggcctaatttcaaagtcatcaatgattattggaatcaaattctttgaaactcctgttaatatgaagattctgacctccttccatgactgttcttctttttttttttttttttttttttttttaagacggagtctcgctctgtcgcccaggccggactgcggactgcagtggcgcaatctcggctcactgcaagctctgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcgtgatccacccgcctcggcctcccaaagtgctgggattcatgactgttcttaatgaaacctagaatggtaaatacttcccattcaccactaaatgttttcaactgactatgctcagattcattagaggtatcactatagcagttatagccttaatgcatttcttaaataataagacttgaaagtcaaaattactccatgatccattgggtgcagaatggatatgtgttagaagacatcaccacattaatctccttgtacatctccttcagagttgaataaccaggttgattgtcaagaaggagtcagtaggtctcaaccttaggcttaaaatgttcagtaaaccatgctgtaaatagatgtgctgtcatccaaacttcattcttccagttaaagagtacaggtagagtagatttagcgtaattcttttctttccttttcttttttttctttgagatggagtcttactctgttgccaggctggagtgcagtggcatgaccttagctcactgcaacctccacctcctgggttcaagcaattctcctgcctcagcctcccaagtagctgggactatagccatgcatcaccatgcccagctattttttgtatttttagtagagacgggttttcaccatgttggccaggatggtctcgatctcttgacctcgtgatgcacctgccttggcctcccaaagtaatgagattacaggcatgagccaccacgctcagccaatttagcataattcttaagggccctaggaccttccaaatggtacatgagcattggcttcaacttagagtcatcagctgcaatttgcccattacacgagagttagcatgtcttttgaagtcattcattcactcctcttgtttagctgtaaaagtcctagatggcatcttcttccaatataaggctgttttgtctacatcgaaaatctgttatctaatgtagttaccttcatcagttctcttagctggatcgggatagctcactgcagcttctacatcagcacttgctgcttcgccttgtaattttatgttatggagatctcttctttccttaaatttcataagccaacttctgttggcttcaaacttctcttctgcagctcccttacctctcagcctttacagaattggagcacgtcaaggccttgttccagatcagcctttgacttaagagagtgttgtgctgatttggtctatccagacaactaaaactttccctatagcagcaatcaggctgttttgatgtcttatcatttatgtgttcagaggagtggcacttttaatttccttcaagaacatttcctttgtattaacaacttggctaactgtttggtgcaagaggcctagatttcagcccatatcggttttcgaaatgccacctccactaagcttaatcatttctagcttttgatttaaagtgagatgagttagtcttcctctcacttgaacacttagagaacactgttgtattattaattggtctaatttctatgttgttatgtctcagggaataaggaggcccttggagagggagacagacagaggaacagccggttggtagagcaaccagaagacacacaacacgtattggttaagtttgctgtcttatatgggcatggtttgtggtgctccaaagcaattacaataacatcaaagatcattggtgtaacagatgaccctaacagacataatagtactaaaaaagtttgaaacattgcaagaattatcaaaatgtggcacagagacagaaagtgagcacatgctattaaaaagaatgacatcaacagacttgctcgaagaaaggttgccacaaaccttcaatttgtaaaagaagaaaaaatacatgtgaagtgcaacaaagcaaagcacaatgaaacaaggtatgtttgtgaggtatgtttggaataaggtattagtcatataaattatggtgaaaccaaattcaacagttacttttcattgcctatccaacatccattcctatatttgttcttactaatgggatcctgatattatttagggggcaatgtgtccaatttaaaacttgctttaaattcccttgcagctgggagagaccatttgacttacatctggctagtgagaaataatctgagaatttctgggaaactttttttccctaatatagaacttgtatcttcctgcttttcttctatttctttctgcctgaaaaatatatttctcagtagcagcattaaatgctagaaagcaaggtgtaatgtgttgaaactttttaagaaaaataatttttttttactctagaaattttaaatctataaggatactaaaaatatacctactatacatcccttttgaacaatctctggatgactggttttaggaaaataaaatatcaaactgagaaaaaaaagaaatatgccacatggagagtggcataaagtaatttgagtactcagaaatgaagtacacttctggaatacgaaagacttgtctccagatgaccgatggaaactgacagaatctttggaattatgtgtaaaaaacatatacactcataacaaatcaggtaaaatatagaaaaaactaatgatagttatgtataacaggaagtcaatagaaaatgtttaaattggaaaaaagtgtagtgtagtcatactcttcggaagcatgaatttacaaatctaaacatagtaattgcaagtatagcttaacaagatcaaggaagaagaatgtgaaaagacgaggcagggaattgctgaatttcatcaaaatatttttggcattatttaatgtttaaccttgtgtacattttacttttctagaagtgaagtttttagttttaaaatattataaaaaggctgggcacggtggctcacgcctgtaatcccagcactttgggaggccgaggcatgcagatcacctgaggtcaggagttcaagaccagcctggccaacatggtgaaaccccgtctctactaataatacaaaattagccgagcatggtggcatgcacctgtaatcccagctgcttgagaagctgaggtaggagaattgcttgaacccaggaggcggaggttgcagtgagccgagatcatgccactgcactccagtctggggcgacaagagtaaaactccatctcaaaaaacaaaaagaaaaaaaattataaaaagctgaaagacaatgtaatatgaaaaactgatttgttaaagattactatcttctatgtataaaagtactccttaaaatgataaaggcaaataattcaatagaaatgtagtcaaaggatgtgcacagtttcatagaagaagaaagaaaaatgtaagtaatgatttgagaggacgctcaaccttactaatagaaaaatgcacatgtgaacgaaccatgagatgccatttttttttgcacatattatttggccaatatgacaaaaattttaaaagactgataacatccagtgctagagatcggaggtagaggcagggagggatgctatcttatattatttagtgtgtgaactgttgttgagatacttttggaaatttatcttcagtttctatcaacattgaaaatatatatacttttaaatgagtaattccacttataggagtctattctagagaaattatagtataggaaacaaaatatgaacatttcacagtgacaaaaattgtaaaacccaagtgttcatcaaaaaagtaatggttaagcaaataatactgtatataatccatactctgagaattacacagctattgaaaaagtgagttaataataccaaagcgttttcctttatctgttttacattctattatgagataataaacagaaaaataaaaccaaatatattaatacaacttttaaattggaatactaaaaatgacaaaattcaagctattccttaaaagtcatgattcctttggttataatgtttcataattgatagctgcattggcatggatttttgcctaacataaatattttaaattaccagttcttcagaaaattataatctctactctctctctctctctgtatatgtgtgttcattcacacacacacatatttagacacacacatacaaacatttctagagaaggatataatgcactgatagtagattataaaccatcgttgcattgaaagtatctttttttagattacttttactaaagtagatgcattatcttctcctatgggagtggagaagaaaggtctattacattaaaagttataacaaagtatattatatgtcaacttgacaacaattgaacaagcgtagtgctggtattgaaagaggagtctaaggggtatatataacaaatcctagatataaagacttactgtcaatcagtgaactatacagttatttaatatgtggatgtatccagttcttcccattgcattaaactgtcttattcctcctttaaagtggtgttatccatctgaacacatattcaattacattttccactaaggatgaactgctaaaatcaatgtcacatcataaacacctgtatttttctttttccactagagtttaagattgctacaattctataagtattgactgacatcattagattattaagaatgaagaacttgaaggaaagataccgtttccatgtgagtgctaacacagaaaatgtatacttaaattctaccttttttcttcaagtaagggctgaatcagattcaggtacacatggctaaagaacttgtttggataaaatgatacatccaggccagtttcattagtgataataaggaagcacttttattattatattgggaatcaaagacagcaaatttagtttttgtaatacgagtagccattaaagagaacagttagcatttctgtgttgattgtggatactgagaataggccagttacttttgtacagagaaagcactcccaccccacctcaccccacctctgcctttgcccctaacttcctatgatggaagctaagatttcagctcttttatataacctctcaagcaaatttattctcctccaacttcctaaaatatttaacacattttcagttaaatctaaactcattatattttatgtttgtagctatataaatattggtcacaacagaaccaaatagcagtctgtaatctcatttcttgtaccgctctctcatttcactctcaccccaacttaaatgttctttcatttacttgacttttcccgaatcacaggctgtcttcccacataccatggtaacttcataaaatggctcataatctgactttccacaaagtcaaagctatcagataactgagcagtttgctctgtttccggagaaattccttctagctcttggttacctgatcccagactgccctgaaggtatactgcatacctcttagcctcaaatttcctttgcagtcctatcagaatttctttttggtgcagtccagtgttcactttcttcatttatttactcgtttcagatgagcacgctctccagttgcttcctgagaaagggctcatggaaggtaaatgtatttatctgcccttgctatggtttgaatgggtcctttccaaaattcaggtgttgccaatgtcatagtattacttataagtggaagctgaacaatgagaacacatggacacagggaggcgaacgacactgactcggtcctgttggggctggtggggagaacattagggaagatagttaacgcatgctgggcttaatacctaagtgatgggttgttaggtgcagcaaaccaccatggcacacgtttacctatgtaacaaacctggacatcctgcacatatattctggacctaaaaaaaaatttaaaaaaagagatgtggcttttaagaggtgattaggccaggagggctccttacccgtgaatgggattaaggctcttataaaaaaggctgaaagaggcttcaagcagcattgggctagctagcttgcctgcccttctctcttctgccatataaggacacagaaagaaggccctcaccagagcggatggtgattccttgattttggaattcctagctaacagaactgtgaaaaaaaaaaaattatcttctttatacattacccagtctcagatattctgttgtagaagcacaaagtgaatgaactaagacatgacatctgactgatattttggttggtatagaattcaaaactaaaaataatttccaactgggtcccatggctcacgtctgtaatcacagcactttgggaggacgaggtgggcagatcacctgaggtcaggagtttgagaccagcctggccaacatggcaaaaccccgtctctactaaaaatacaaaaattagctgggtgtggcggcttgtgccagtaatcccagctactcaggaggctaagtaggagaatcgtttgaagccgggaggtggaggttgcagtgagcggagatagcaccactgcattccagtctgggtgacagagcaagactccatctcaaaaacaaaaacaaaaacaaaaacaaaaaaattcccctaggttttcagaagtattgtgttctaacttccagtgttgcttttttgggtttttgctttctttatagatggcttgcttattttcactctagaattttctaggatcttcctaaatccatgtttagaaatctgaagatggtaaatattggtgcgggtctttcttatttcattgtgcctttgtggccaccatgttcttcatttctggggacatcttctcattttatattgttggaaattccctcctctttattcgctctgacttctccatgtagcacaactgttttaaaggtatggagctattagtcacagtctctatttttcctgtcttttctttcctgttttcagttctgtcattttgttcttctttctgaaagatgttcacaactttcccttccaactcttaaaatacatatttactttgtactgtcacagttttaacttccaatatttcttctttgatttgtcaattgtaatagcattatatttttattcatggagttagtatattgtactgtttctctgcactgattatttttccgctcactgtattcactcaggtaactatgaattcatctcttatgttagactattgtggtctctgtctttatgtcaaggaatttccttaagccatctcttttctttctgactacttttaagggcttttctttgtctccgattttctgttatttcactatgatgagtgtaatgaggagtttctgttcatttattctgtttgagattcattgagcttcctcaatgtatacattaggtctttcaacatttctggacagtctcagctaacttctttgtattggatcttccctattttgtttatttactagaactctgacatactctcgtttgtttttatttatttagacagagtctcgctctgtctctcaggctggagtgcagtggaacaatcaatcttggctcactgcaacctccacctcccgggttcaagcaattttcatgcctcagcctccagagtagctgggactacaggagtgcaccacgatgcctggttaatttttctatgtttagtagagatgaggttttgccatgttggccaggctggtctcgaactcctgagctcaggtgatccacccaccttagcctcccaaagtgctgggattacaggtgtgagccactgtgcccagcctgacatactcttttttagaacttctcattgtattttccatgtcatttaatattttattcatattttctatctcctttcttcagatcactatttttctcttcagctatttaatcaattcattgaatttttttattaattttgatttctagatttatttggttcattttaaaatacatgtggtcatttttcagtttcattttcaggaatataattgccgatcctctgcaaaattcttcagctaatattgacttgaagcaactacaaggctgcccccagatagtttcagatatctgcagttggctaagtaacttacaattagtacactcactttctgtcttctaatattttgttggtatcctttactatgttcaatctcctgatatgtttgtcattgtgagtttgcatatatactgtagttttaaaaaattgatattgcaatatttaaatgaatgatattgcaatattgacatggaatagagattgggagaataagtatgaagtatgataaaactactatgtttaacaggaagttaatacaatgtattagttaaaggattttactactaatgcacaaccccaaatacccagattatgtgacaattcataattttaaagaggcacatcataacattgttattgtctatccagtgactaattaaagtataatctttttaaatgcttgtttttgaaatttataaagttcatggataacagttcagttgtgatttacttgtaaaatatgtaaggatagaatctatttgagtacattaataaattattttggccttccattttgcagtttttaagggctgaagagaacactcaatttttcatttgtactatactccattacgtatgaaataacagatgcacatttttgttgttgttgaaagttggggcctccaaaactttatgacagatcgttcataagtttcatggttctaatgactggaaaaataatacagaacttaagccatggagattatgggtagagagtatagaatttatatcacataaatcagtataagatgttggtgttttaagagactgttactcatttcatatccattactcagatagatcactttaatttagaatccttcaactttaatgattctgtaaataatgggaaggtatatcactgttagtgctatccaaatcaaattttatacaaatttatgattaattcagaatttctaaaactccaaaggcattgggatattttcattaatacctttagttttgttcttatttattatatgggtttataactcagtttttaaaacactaggctactgaaaaatcctagaattgagtaaagttttcttttttatataagctatttctaaacataaatacagaatttctctccataagttatcaacttgtttatttttcaaagtcactaaatagcattattaaaatagcaagcattaattaatgagtaaaaaaagataaatcagaaatagccatgcaaatattaaaaataagatgttttggagattagtcatctttgaatcattttatctgtactcttaggtcatatttcacatactttttaagaaataaaatgctaaaacgattaattttcttaaacatggatatttatttattgacccatttgaaattaaagatgaccaatttcatacataattgattatagtattttggtatatccacacaatggagaattatacaccagtggaaacaaagacaaagaaatatctttatattctattaatgagtgacctccaggatatttatttaaattaaaaaaaatatggagaaagaggaattttactaaggaggatatataaatggcaaataagcatgtgaaaagacgttcaatgtcattgcacattagagaaattcatattaaaatgacaatgaggccaggcgcggtggctcacatctgtaatcccagcactttgggaggccaaggcgggcggatcacgaggtcaggagatcgacaccatcctggctaacacggtgaaaccccatctctactaaaaatacaaaaaattagccgggtgtggtggcgggcacctgtagtcccagctactcgggaggctgaggcaggagaatggcgtgaacctgggaggcggagcttgcagtgagctgagattgcaccactgcactccagcctgggcgacagagcgcgactctgtctcaaaaaacaaaacaaacaaacaagaaaaaacaatgagatatcataacatgcataagagaactgctaaaataatttttaaaaatagtgacaagtgaccatattaagtactggcaagaatgtggaaaaactagatcacttatacattgcttgtgggaatataaaatgttacagccattctgaaaaacagtttggcactttttaatcaaattaaacatatagttaccatatgacccatcaattgcactcccttgtatttatcatagagaaatgacaacttatgtccaaacaaaaggagtacacaaattttcatagcaactttatttgtagtaacaaaaatctgaaaataacccagatatccttcaacaggtgaatggctaagcaaattgtggttatatacatagcatggaatacaagtcagcaaaaaaaaaaggaactagctattgacataggcaaaatcttggatgcatctcaagggtatgatgcttattttttttaaaagccaatttcaaaagattacacttgtataaatctatttatacaatatttttgaaattagaaaattttagagatagaggacagattatggtttccaggcgttaggaatgcagagagtgaggggacagaagtaagtgtgactacaaaaggttatgtgagggttgcttgtgatgatagaactgttctttatcttggctgtggtggtaaatacatgaacctacacttgataaaactgcatataattatatatacacacacatacacaaaggaataaaagtaaaacagggaaatcttcataagattggcaaattatattaatccaatatttgtgctcttgtaagtttaatctgtacttcataagcttacctcaaattactgtgaacctacaagtgctaagtcagaagaatcatgcctataactaggtaacactgaggtaggaggcaggactcaactctggaggcagggttcagacaccagacccaattgagacctagctaaaacagggccagggcagaagcagctttccacaagacaagacatgtccaccagtgtgccatgtcagtttaccattgccatagtaacagccaaaggttaccgcccctttccatggcaacaacccaacaatccaggagttaccacccttttcttggaaatttcggcataatctgccacttaatttggatgtaatcaaaagtgggtataaatatgactgcagaactgcctctcagctgctgctctgggcacactctctatggggtagccctgctccacaacgagctgtacctctgctgctgtgtatgctgccgcttcagtaaaagttgctaacacctctggcttgcccttgaattcattcctaggcaaagccaagaaccctcccgggctgagccccaatttgggggcttgcctgacctgcatcatcaccactatttgagtacaaaaaatgtagttgaagagacaacccatagctttgttaaactatttacactcactgatatcaggaatcctgtttttaggagtaatcattgtgaggaaaaatatattttcacggaaccacagaatttttggtatgtgctacattaagcaagcgcaccaggtttaacacctgagctcatgttcctaccttgaagttaaggcaaaaagctcaaatctaaagaatggatgaatttagcacaataaaggtaggaaaatgttgaccagccatgctcatctatacacaatactcccagagggttccatccttattattactacatgtgataaaactgtctagacctaaatacacacacatacaaaggaataaaagtaatactggaaaattttcataagattggcaaattttatcaacatcaatatttgtggtagacaatacacatggtacacttacaccaggacacaccacagccttgacctatggttattgtcctggttactcctgtcctattaaaataaggatgaaaaactacattaacaatgatagcctttgttgagtacttactatgccctgagtacttgctaaagttttacttctgttacatgctacaagagtacttgacacatgcatgaactcagtaaattacaatattcctatttcattataataattttacaaataagaaaacaaacttagcattttaaataaaactggcacaaagtcccatagctaataaattgcagaggtgggattattcattagttattcattcaacaagtattaatactttattaatgctctagaaatagcctttaacattaatacctataatattttttgaggactcactagaggctaagaaatgtatttagtactttcatcattacaccaaataaacaacaatgtgttcctggttgcgcaagtcactaacccttttgtgactcagcttccttcctgtaaagtgttaataattatactacctctactccatagtgctattgtgaaaacttacacgaaatggtatatgaaagatgcttaaaatactgcctgccacataataaatgcaccataagctgtcattgtcatcatcaactcactgcatattgacaattccttatagtagaaatctcatctgctataccgcttactaacagttttatcaagaacaaccattctgtctcataccttcatcctttattattatactactactaatataatatagaatatactgataatatattatatattacatagtatattatattatcatatatattattaacatatatattacatatattacaattatatattagtataacacactaataattgtataagtattatataacgtactaattatatactataatagtatattgtgttataattactaataattatattaataatataatatgtattattcatatttagaggctgcagagagaaggcaaaaagaggatgcatctcagggaatgttggatgtttaatctctagaataaaagagaaagaaaagaaaaaatagaaacacaaattggtacatctgggcccccaccagaaggtgaacttaggtgtacagtttcaagaagcataacatgagtggacaagtctactgccaacaactggttaatatctgcaatcaggtggaattcctcaacttaatttcttctctgaataaattaagattcagactttgtaatactattgccctgaaatgtaatgctaaaaaaaaaaaccaaaaaactgattttcaagcttagaagatggctacacctttcactaaatacttattttactacatttgctcttctgcagtaagctactgatttgctatttttcttagtatttaaaagatgtaactaaatagtgaatatatacattgcatataaaattctgcatatacttctaagattaaaatttgcaattgtatttccatctctcataaaatgatctaatgacttaaaaatatttataatatataaatatgtaaaaatttgttaatatataatatattaacctaatgatatattatttcataatatagatactacataataaaatatacattattcgtagtatattatatataatataattagtatattattatatatttgtatattatataccactaataatataagatataataataatatgaatagaatatatattgcatagatttgttgcagaggttcagtgagttaattccttcatggtgcctgggatataagtgcacaggaatagttttaaatgagggaagcacctaatggaatgaggaagggggcagataggagtggcttcacccttgaaactgaaaaataactaatttttgtatatactacgtaaccatgagggctcactgcttttctgtgtcttcatttccttttttaagctgattttgaggccaattttcagtgacatctttaatgaaacagagttgtgtagcagaaaagcactggctctgcaattatacaaaccaaggaagaatgctggcttccttatttaacagctgaatgatgctgaatagtacacttaattctctgggcctcagttttattaactaaaatttcaacaaataacaatataaacaatatgaaaatatttaaaacttctatctctaaaggctgttaaagctattttaatcatattgtctattatataaagtttttagatgaaaagggggttgctatacaaaaagatttgatcttacggttttgcaccatcatattaaacatgtttttccccaatagtagcaaattcagcaattctccaaccaacttccggggtagcactgcctttggaaaggcatttacaagttggtttaaatgttacagggcttattatggatacatctcatgtattctgcggcaggtttcccttttatgtttcaatgcctcaaaaagatctcttctgatactgtatttttaattcatttccacttgtcaaagggggatatcaggttttatttcaaatttgtgtcatctcattgctatgtgatatttgacattacaaaatatagtgcaaatctccacatattaagctcgatatagtcataaatttgtactccaagccctcattgacttcaatagggcttggacttgtggaatgattgcagatcaaggcattttgatataatgtaattttttaagtagctttttttccataaggagaaacatgctgcgaatagcaaactacctgcacagcatacacacagcagtcagtaatcctggtccttgtcaaaatattttctgttcatatgtaagtattgactgtggtgagagacttaaaatgactttaaggaaaatctctgtggtcacactctactccctattcacataacacaatttgaggaacttcattaaaatccattcttatagaaccacccttgcatgctttattacagtaaactagctatcaattggactattgacgttccacgtatgcagatcatagtatcttttccattattttaaaatgcttttgtttctaaatgaagatttattttgccagttgatcacagaatgagcatgcacaataaatcatgaagagcacagtctgcaaatatatgtttcaagttcaagcagcaatgatctgctacttacaatcctgaagataataaacatttttatccaatcatccagagtctaaagaaattcaaaaaaatggaaactctttgaaatatacaggcttttgggtatcaaattacctttgaaaccccccacccagaagtatctctaacaaaatccatttgaaatactgcttcaatattctaaaaaatcaataatttaaaccacaggttgaacatttttactgcttccactgcagactgtcatttttcgaaatgaaaatgctaatgataccgaaggggaaagcactaagccgaagagatgcatgaatgaaacgttggattggctagacttgctggtttgatctctttctccctcactcatctgtgacaagatgtcttttaaaatcaacaactttcatttcagtgtttctaaaaaatgcacttctctgttgtacattacatccttctctacaggaagttaaggaatatgctctagcaagacattttatagtaaatatgaatacagaatgtaataccaagtaggctgtcttatttcagtgcaacctataatgttgggacacctttaaaatattgcagagagcactggagagaggataatcccctcgtactaacggttttcatattcataccactgtactaaaacacaagccatgaaggaagccatggaaatccagagcccagaggagttcaaatcagaaaaaactttttcattgcctttgaaatttatttttgtctttaaagatttaagaagtaaaggtgtgagatcagggtcattgccttctccatagggctcctggctttgaatttgctctacctaatacaggatcttgctagtaaacttggttaatgtcaggtggagcaattttcatccaagaactgggaattatgattcatgggatgtaaaacatcttactggagggaagactagggaggtggagaaaacaaaacaatgattgtcaatgaatagccaaacatggtcccatgagctatgggactcaaaagggagaaagctggtgccctaaaataatggaattaaaaagaggcccacagcaaaccttttaacaagtttctcatttctttcttaaaaacctacagaaacctaaattctacccgcagcaaaatgatagcacacaaatattattgatcgatttctataatgtgataaatcacatcatttccatctggaagcaaaaaactctaacaagatagaagagggcaactcagtctttgttgagtatctgctgtgttcaaggaactgagatatgactgtagggacagacagaagagaggaattcgaaattattaaagctcagtttatccatgcagtggagattatgacatctaccacagtgagttgctagtagtaaaagagaaaatgtaaattatatggctttcgaaatgcttgacaaataatatatacacaataactacccaatgctagtttcacagaggaaaatggacctggtatacagataactctaaaaaaatttaaaatgttttaatttttgtttgtttgttttaaagataaggtcttgctgttgcccaggttggagtgcagaggtgcgagcatagctcactgcatcctcaaactcctgggctcaagtgatctttccatcttagcctgctaattagctgggactacaggcatgtgccaccatgctcagcttaaaaaaaagaatttaaatttagcatgatagaactgaaaagagctgatagctggttcacctatctcattttaaaaggcttcatagtgtgttagtggcagatttgcaatttcattgcaatttctgtctttttcctcttaacacaggcggttctaggactcctacagtttataagaacacaactttaagcctgggcaacatggcaagaccccaaatctatgaaaaatacaaaaattagccaggcatagtgtcacactcctgtagtcccagctgctcaggaggctgaggcgggtggatctcttgagcccaggagatcaggctacagtgagctgtaatcatgcaactgcactccagcctggatgacagagtgaaagtttgtctcaaaaaagaaaacacacacacacacacacacacacacatacgcacacacacacataattttaagataaaagaaagcttccagggtgggtcacatctaagccggctcctgaggatgaattgtattctcaaaagtcaaaatactgggcagagctcttcagatacgagcacaatgcatgcacaagtgctggggcagaaaagcacaagccatcttcagagactgtgcatggcaccctcaggcagttttaccttgagtaatgagcggcctgcgcatccatgtgcacaatcatagtttgtggattgaataacaaaaacatcatgtgaagtctgagaaattttatcaggttccaaagggacaaatattttaaacatgttaaggcttctgttattgtgtctcctttatgggaagaggttggtgggaggaattaagactaagagaaagttaagatgagagagggcattgtaggcatgctaagatttatggcctttctcctgcagataagcaggagagagagagatgtcaaaacatactttggggagatacagttggatgaaaatatgtagattaatttctgtaatgtccagaaagaatacagaaatcagattttaagagtttcaggcagtgtcctttctttgtgctccctcttcccttcattgaaagttaaaagtcaaaatgtaaatacagacttaaaagggtaaatcattctgtttttcaactttattcatgtgaactcaatgttttaataaatttctcttcccaagccacatcaaaatggtttgttatattgttgattttattattattgattatattattattacattagcatttgaatctgtgaagtgctgtaagacagtttgttaacaatttgtcatgacacctctgctgggtgggaggatgacacacatcattatcattattattaagattttcttttacagctggtatcatgataaatgatttacagataaacatagcaatactcaagttatttatatcaagttaattaatcatattgatttaacatcctgttctgttatttaacttttcccctttctatgttagttttagatctaattttagaataattaaatagaatttgaaatttagaactctgcattagtacctatatcacatctgaaaaattattaacattttcagatcaattttaataactgcaggtcctttattaggttgaccttttctttccaaatatttgacatcattatagttggagaataaaagtacctattgacagttttcttttgatattgaaaggtcctgcttcagtaactgcacagaacatagtaaccatgtttttctcatcttatgttcacttcctttgcaaaacaacaataaacagctggcaagtcagagataccagagtttttcctaacttctctcttcccatatctagcctcatgcaatcagtcaccaggactgctactttactctcttttatacatgtcaaatacgttcactttgctctagatacaaccttgagccaatatcttttcttccttactgtattacactgtaagctccatgaatttagggccttatattcctctccactctatcctcaacatccaagcacattgcctagaaataatttgtcaatgaacatgttcatctgctctcactcttgtgactattttctacactattatcagataatcctctctaaaatgcacatccaagcctgtcttatccttctttgcatatagttcattatcctttaagataaagttcaaactctctttgatgatcaaacaagggcctttattatgtggttccattctaattcttattctcactacatcatccttccagtgaaagtaaacacccatttttacggggctttctttttctctctgactttgctcatgatattcatctataatgtattctctattctttggacaggcactatgcagggcaactgtttggtatcatcttttttccaatggcattccttgctctagcttggtttggtgcttcctctgtagttttatagctcttcgtttctaattctctcatagcatgttttctcacgcacatcacatctagattttaggttctctgagaaccaggattgtatcttattgttatacaatacatgatctataaaaatgaacaaacaaattacacagagtataaaatactataaaaatacaatgctaagggggccaagtatgtggtttaagagcactctattgccatccaaatgaatttgaacaaatcttttgattaaagaataattttcattatctgtaaatgaaagctcttagactcaagctagatctcaggcaagtctttttttaacactcacagtctgtgctattatatctagaatgataaaattaccaagcagggcagaagtgagcagggaacgacaattgattcagactcctagagtaatgatctttctccttgctatctacagtatattaaatgctttccttttggcttctaattctgtatgttttgctcaaaatttagctaggaatatttattcatttctttgaactatatataaacagtaagagactactcattgaatatagatgatcctgtaacactttcttccaacggcaaagaacctatataactagctattctttggaagttgcctgtaactccaaaactctatttttagatttgctattacaccatgtttctaacagaactgggtcaaattgcccctgatgaccacactttctgaataaggggaaaaaaatatggaaagtggaagctactttaactgtcaattatattaaccagttgccacaatgattgttaataagaatattaaggaaattattaggccttcatatttttactttttctacttatcaataacactaggagtcaatatcataatgggaaacaacttcatacccactatgaagtttataacaaaaaagatgaacaacaaacaacaatgttggcgagtatgtgaagaaactggaaatatcatacattgctggtgagaatgtaaattggggtagctgctttggaaaacagtttagcaattcccaaaaagttaaaaatagagttaccatattacccagaaactccactcctaactatattccaaagggaattgaatatatatgtatctcccctcaaaacttacatatgaatgaagaaatatttataataggtaaaagtagaaaaataccccatgaagggttatgaactaatgaatggataaacaagagtggtatatccacagaaagaaatgaagcattacattgataaatgctacaacacaggtaaaccctgaaatattatactaaatacataaaagaaaccagacattaaagtcatatattatatgattttgtttatatcaaatgtactcaataggtaaatccatagagatagaaaatacattactggattccagaggctgcgggatgtggggaatggggagtaactgctaatgggtatggagtttctttcttagggtgatagaaatgttttgaaattagatagtgatgatggatacacatttgtgaatatactaaaaaccatgaaaagttacactttaaagaatggattttatacgtaaattataaaaacaaataattctggagatgaagttgatggttaagaacactaaatattatattttcgtattctgaattttttaaattacagggataaagctttccaagtggttaaaagagaaactgtctttacactaaatatacacacacagtactttgcctctctctctctttctctgtgtgtgtgtgtgtgtgtgtgtgtgtacttatttaaaagccaaagtaaagtattacatgaagttctcaacagataattgcataaaatcatgatatacagaattcactcttgtgatggctatatattaatggaagccagctacattttaaaaattattttacattttttatatattgacaaattatagttgcatatatttatggtatacaaagtggtgtcatgacttttgaatacaatgtggaaagattaaattaaaccatttaacatatcacctcaaacatatccatcacctcaaatatttaacattttttgtgattagaacattagaaatttattcttagtgataatgaacatacaatgtattgaaatagattaaaatttaatagaaaacaacattgaaatttatttgtaaacataaagaaatattttttcttaaaagttatgatttataaagagttcttctctaagaccttaatttcactgatagatctacttggtatttcttttatgtaaacctttataacttataataaataactttaaaagttattttcatgaggactaagatgaaaagttgagtggatcaaaatatagatgggttggagttacagcactgacctctatctgatttttctccctcaggagatatatctttaaataaacaatttctgtttatttaaaacagaatatatctttaaataaaacaaatttctgtttgtttagccttgtattcctttggtaaatttggtaaattcatttttctgctatcttgaataatttgtttatgaagtcttccaagactttgtaacctatgcttcaaatggaatgaatataatttttctacattcttgaaataaatatttttattttacatccatttttatgtctgagaactagtattttagaacattgaaaaacaccttttgtgttaaaacagtaaatattttcatttactatgcatatatctccaagattaatgctaaggcaaagacatttcagagactgcatgatgtgtatttctctctatctaaaaacatatatagtatatatacaacttcaaattctccttggagaacagcgggaacaaaaaaacatccatatctatctaatcacatacagacttacttacaaaaattacttacaaaagaggtgaccctcaacacttttctcaaaacaaagggaaatttattttatttaataagaaagtcacaacaatttttgatactataatttaatttaggccttcttatctcattacaaatacaatttttatttagtaatctagtttggaaatactgaaaagtttttcaagttttatttacacaatagtgtaagtcaatccaagggtcactgtgaacttgtggttctttgttacaactgcaacctaatgttctattcaaagtcttattgcaaaatcctcaaaatatgatgaatctgggtggcaaatggtaatagaggcaatcatttacattcaggtctcttatgaagaggcaatgtgtatgtacctaacatcatctgtaaaggacctatattctccaatggattcatttaatttatttgcagggtgaatttttatgttagtatttcagccataggtgacttattgaaatgaaaagttaaacttcctcagctacaaagaacaataaaaacaacaaagcaaacttctagaacttttagttttaaaggcactcaaattttacaggtaattcatcaaacaccactcacatccacacagaaatcaaatacatttaattatgtattgaaatattttttcttacaaattaaactacaggcaaaatccagttgcatgacaaaactgcataaacagtaaaatgaaaatgctctcattacaaatacaatttttactcagttaaaatatcatccaaacttatatttgtatcatgtctaatatttttatgattcacagtgatatataaattaataattaaataatgaattcaaagctcttatttcaaatgtcttctaatcagtcattttgttatcttatattttcataaaagaggcattgttttagatgcatgggattatcgttttttattttttgccaaatatatatgttaaaaggaggaactgtagaatcatacaaggcgtagattaatataatgtgagatagtgtatcagaggtgatacatgccacgcaagcagcatattttacattctgacacacattttaagccttcttttactcacgtaatttaggcttcagatgcatttctcaattgctcactgcagaatagctgcagaactgaaacaaaaccttcagtacaaaaatgacaacccttttgtttccactaaatccgtattctgtcatccactggcagggagttttccagtcatgttctctgccagtccttaccagtttgccaattatacaagctgcttcccagacatcagacacaaattccacaagactgctgtgcaagcgtaccctaattaaccatcagcttaattagacaatttactgtgtaattagcaggcaattagtcaacacctctcagatcttattgactgctgtgacagcctttcagtctttgcacattccaacattccaatacacaacagcgaccatgtttctagcactctgaaaccctgtacgacatagttctggacggagaagtgggtaatattatataacaaaggaaaaaatcaatatggagcctgtccaattactgaactgtttataaacttgtcttttatttaataccagaagtctaacattaaaactactttaatatctgcttcaaaatggttatagagccaacttcttaatatgttctatttcatgttttaatgtaaaacactttaaatttactatgaattatacccccgattggctctgcctatagtaacttgagtaaattttcaatcagtgtatcagagatctactcaattaaatccaattaatgtggcctggtgcagtgacgcacacctataatcccagaactttggaaggccagcacaggaggatcacttgagcccagaagtttgagaccagcctgggcaacataacaacaccctgtctttaaaaacaaaaccaaacagaaacacattagccaggtgtggtagtgcacgcctatagtcctagctacttgggaggctgagacaggaggatcacttgagctcaggagttcaaggatacagtgaatctacactccagcctggatgacagtatgagaccctgtctcaaaaaaagaaatcttactcatgttaatagcagttgtagacacaaatcctacaaacactgataaaaagtgctctggggtagggaagcgttttttagttttctttgagtcagctacgaagaaatcacacctcagcattttaatgtttacattaacactttacatgagttacatgattttaacatttaaattaacacattaattttacatagaaaagcatgtttacaaatgtattcctctgaggtcatgtatatgtcatataatacccactgctctttgtaatgcaatttctgacctatataaaatattttccattatctcgagatttcatgacttgtaactaatgagatcccaacaactgtaacaaagaatgatcctttatcgcttttctttcagaaatattacagaagaggataaattttattgaatgatttaaaagtcataagatcttctgttaaccaaaaagaacaggaggaaagaatttgtgaccactccttcatagtttaattggttaactgccacatacattttctaacacctgataaacttccataagtataaaaccactatgacaacataattatttctgcattatctaaactttgccattagcagcaattttctttttcttctttttgaatgtaagggcctgaaaattaccagcaagaacagttattgaaaggccacaggttggaggaatctagagaagtccattgtggccttattggtaccaggtaaagtagaatgagatgaggaccgagagacaggcaggagctgtttgctgacatgatttgtacaaagattctggattttattttaagggctaagagaagccattgaaatgttttaagcaaacagccacgatctgatttaagatgtcaaagtccactctgacggtggtgtggaggccggaatttaggataagagtagaagcagcaagactcttttaggaagctggtatactattctgtgagaaatgatgggggctgtgatgtgggtggtaccagtggagatgggaagtgactttctaccctttaataactgatcacataactattaatgttttagtctggcatacagattatggtaataagaattataacttttattgacagggtattttacatgttacgaatcattttaatatatttatttaaaaaaaattcaatctaagcctcactagaatactgtaaaaaggcagagcaggtattatggtctattttgtaattcaacatgtggaagtttagataagttaactaatttattaacagtcaaattacttacagaagaggtaaccctcaacacttttctcaaaacaaagggagacaactgtaacgtttcaataataactagtatgattcactatgaaaaccataatttaaaacttaagagtatattgtgcctctctagccttctgcatgcaagcttgtttttctcttttcatattataatacttaataagataatatttgtatacattttatttacctgtggatctctgttgtctatacaatatttctctttatattgatcaacaggagatgtccaaaaatcacaccaatgtttgtttattccccccatttaaaagccatatactaagtggctgcctaccttatgctgagtattgtaaaagatccaaatatctttgtggcaatctcacgtaactccaactatcaggagtataactgagcaaggaccccagctgctgtgctgtgaatgaatccactcctggattttcactgcagccatgcttcctgtggcttagccaatgactgagcagggcagagatactaagcaggccccttcctgagagacatgaagactctagatggctttgtcgaagctttctcagtctgcaaggcactctatgatgctcctactcaacctttctttcttctctccccaatgtatggcttgacttctattgctgtcttatggctctcccagtcctcctcaacaccctccatattgtctcccacaattatttcacctaatcaaatccatgcatgtttaatcacatcttggcaacggtttcttggaagatctgaactaaaacctgctgccatattaaaaaaattaaatgttactgacaaaatccagaaaaaaaaatctctatatgcaaatagttgtatgaaatgtaagggtttttaaataatgcattttcatatactaaatgtccataagtaaaattcaatatggatattattaatgcaacagaatattaaaatatacattttggctgagaccttaaggggcattgagataaatcacaaaaataaatttttcccttacagaaatgttcaagtagataacaaaaatctgcttagggaactcttacacccttcactccaatatggaaacaaaatgttaacaaaaagttagggatggatgttggagattatgacatggtttctttggagcatgcttctgggattatatgagtcccactgtcatcccaaatcctgagagacagcttttaaaagggacccttcagagcactttatatgtgttccccgcagttttattttcttttttggaggttggtgcaccgtatacagtgtcccactctgcttgatatatcgaaaaggtgtgagttgtctgttgctaaaagatgagctaaaagagatgcaactgtacagcaactagcctatattcctagaatttgtcaggggaaaggaaatgtaagattttcctgtggaccaattaagggacccatatttaaataagtaatgtgaagtcaccttaagctctgttcaatatggtcccttggaaaggcaaatgtgttgcagcagagaaaagctaagttactcaatagcttcctaggagtttcctagagagcaagctatgaccaaagattcaaaagcaccatagggaagagttcccaagtgatgggaagtatttttgaagaatgcttggaggtacccattagataaacgttagtctaaacaaaagtatgtctcctaaagaggaatattatagctgtacaaaattatatttagccatgaaagtgaaaatactcttcaagaggtaataatatttatcaatttaaaattcattatattgctgaacaatgtattacattgcaaaataaaactggttgataagaggagggaggtagtcagtcagcaggttccctttgcagggcctggtggtcacgagatctgatctccaaaggcttccattcaggaaaggggccggggggtggggtggagtttaaaaggaatccattccctcttgtgtccattgagtaaaattctataagagctcagacaatggagagaagataaccattgattaatgtagctccaggggacttgggtggtcattggccttttaatatttgaagaacaataaatgtctccttaccgataaagaatggtaaaattaaggtatagacgatgcaaacataaacctggtgataaaaccagttttgtcagaaaagagagtttgtatgaggagagaagtgaaagttattgttgaaatgataaacagtagttgtattatgattaacagtctcttccaaattgaattatgtaatttctttgcttaaacctcttaacaacaggttccctgtttatacaacaacatttaaattcctaaccccacaggcctttctcactatctctacagctacttataacatttcatgagacattatgctgcatcttacatatgctcggttctctcatgaccgtgactatccgtgtgctatcccttctccctagaataaagacagttcaaatgtgaagaaaataaaaaaataaaatattgaaaataaaaaattattaaaaaattaaaattataaaataatttaaaaaataaaatattgcatattaagtaacattttagtattaagtaacattttagtctaagaattcctgtggccttaagtcatcttacatcttttggtgtatatattttctgaactacagtttaagttgtctaaagtgaataccatacattacacacatatacacacacacaaacacacactcgaaaaatagtatatataaaaggacattataagagctctcaaaatacatcaaatcttgcccagatacctaaaaatggtactttctttaatgacattttaagctaatttttcacataaatagagggtaaatttggcaggatagaagtgagaaactgtttcagacacatgagatattgtagaaaaacatgcaaatgaggaaagcagggcaggatgaaaagggcaatgggcttagctgaagtgaaagaagcagatgaggcagtggggtaagaaaaggtaattggtgtgtgatagggcagtttgagtgaatatttaactaacacaccagtaacttccttgagttagtgacactttatttctcatgacacctcatttcagaaatagtggtacttgaacattaagcacattgctagtcctttaggaaaaaggagcatacagcgaactgtaattttactaaaacagagtcagtcttgtaacaaaatagccaatgtaggtatgcctttaataaaaatctgacagtaaggtaatcatggtataaagtatttaaaatgagtataaagaatatcattacatagtagttactagaatcttattaaaaagcaataaagaaaatacaaaggcaaggagaatattatggaattcaatccaactaatttcaaccaaagattgtatcatctaaacatacccaaaatatggagatttttaactggttaaatttaaaattcacagaagaattatgtgagacagaataagggtaaaatcagtttctcaaacagcaggactgtactttaaggaaatttccattaaccataattatgagaattttccattaaccttgacaccacttgctttttttaaaaaaggaaactgaataagaggtactttccattacaagttagattcatctaccagctaacccagatcaaaattgtacacgtcaatttatattattaaaaagtctatttgagtttcactttgtccactctaccaaaatgattaactaattaacaggtgtgaaatcacagcctgaaatgggaaagtggtgaagatgtaattatattggaaaattgattagtctgcttcatggttaaaaatattactttggctataattaaaagatttttacttaatattcgaaatacatgcattaaattgtgtttgaaagcatcttaatctatattttttacttaacagactaagtctggcaaacatggtatgattgcgaacagagactgatttaaaactttaaggatagacagtggtgtattcattagattctaacttgcaagatttagcttcaatattgaatgtgtacacacgagtgtgcaagcacacatacaggttcttttgttgatgaagaaatgagggttacgtcatagaagagcttgctaaatagtcttgaagtgaacacttggatgaaatgtcccataggagtactatatgtgaactgtagccatttaataaactaattctttataattggaggatgagttgattttatgaatttcaataaaatacgtctaagttataagaacctagctaggtgataaactattagtatacagaagtcatctcagttttcagcatgttaaaagtctcccagataaaaagcttacattgaatttatttaaacaattataactcctagttaatgtatattatcaggaaaacaatactatgcaataaatagaaaataatcatatacaaaattggaagctagaactatagcagcaaaaataatgcactggactattgttaatttattgtttcatagactttcatgatgaggtaatagataaactcttaataataaataagtaaatcagttttatttaatctttttaaaaaatccagatctttatttctaacaaggtttccaaaatgagtttcaaaaataaattgtgatgttttgtattgtaatccatagagaattacccaggctctaaaatattattacatgacatgtttgtgaaattttcaactttaaatattatctttagcatttacagtcctgacaatgttattcctcagttctcatctcgttgataggtgctggcaatttgtgcaatttgtgcaaacgcaggagcaacttcctctcaattaagataatgtggattgaaacaagtttcttggaatccacatgggagaacagacaacctacatggtaaaaagtctgcaaaccttattatgaaaagaaaaacagaactatttagaaaggaaaaagaaaaggcttatggataggacatgagagctgtctccaagtaactgaagagctgtcatgtggaattgtggttcaaattagaatactataattattcattcatctaacaagtatgtattgcgtcctttctatctgccagacattgttcttggcactgggcatgctgtagtgagcaagaaagacaatatctctctacttacagagcttacttcaagtggctaaaacagaaatagatgtccaagagcatggcaatttcatatggtgataagtgcagtgaagaaaaaaacaaccaatgtaatgtgggatggagagcctgggttttgaatggttaacaagagcttctctgaggaggtaacttttgatctgagaactgattaagaaaaaagagccagtcatataaatatctgagagaagagcattccaggcagatcaaacaccaagcaaaatggtcctaagacagggaggaagttgccatgttggagaactagaaagggggccagtgtggctggcaaaaaattggcttctgatgacagcagattcacagaagctgttaaatcaaaatgctctcttgtattctctctgaaattgcacatagaaatataaaatttctgtgcaacttttatttctcaatagaaagacaagcataggtgccactctatacgaagcagtgggtagaaagtcctcagtgtaaatgctcaggctgaactctaagtctctgaagacatgagtgcagtcaaactgccttcattttagacataaagtaatatggtccagagaggatacattatgtaaaagcatgatatagtggaaattgcagggatttgtatcaaatagaccttggttcaaatcctgacgtggtggatttcagtgttttgatgggaggggccatttccatgctgttacaacctgatctggtcttgtgatgtgccctaaagaatggaacacaatgaaaattatattgtgcaacttccgagccttggcatcaagaggatttgcaacttctcctcctgccttttttgtagcactgacaacttgtgaacaagtccagtgtagtctctttgaagataagaccatacggagatacaggcctaatcacgtcagctgaggacccaggcatgtgaatgaaatcatccaggaccggccatcagccagccaccaaacagtctgtcaactgattgcaaatccatgagtgagaagaactaatatcatgtgaagcaaaggcaagtcaacccagctgagccttggccatactgccaaactgtcgaaacaagagcagaaaacgtgttgctgcttttggtaaggttgtctgatatgcagcaataggtacgtgatgctgaaataggttatgtttgctagcataacaaaatataaaacatgtggccctggctttggcattgtgaggcaggcagagccttgaaaaaccaagagtaagatcttagtaaaggctggaagaatggtgaacaaactgttgtagaggtttaaaatatggtatgaaaattgttattggagggttggaaaagtggcctgtattatgtggtgacagaacaattggcaagaatgtcagcagtgataatttggaaaacagaaagtgaacataatacatctctagaaagaacactgaacgtgttcagttgagtgtttctacccaagtgtgataaggtactaaaagagagaaaagagctaaataaggctatatttaaatttgccatgcaaaacagacagaatccaagggacctaggacacactgggtcagaaaataaactattctttatatttgttctctcctagatggaaaaaaggttctcaaaataaagtaccttaaagatcatctcaagaatattgcagtaagacagtttgttaagactttagaaagacctaaggcaggtcctagtagattctctcagggcttctaacattcctaaagacattgtaccacaacagcaaggcatatccaaaaataaaagaaatctgtttaaaaagaattatggatgtgactttgggcatcaatttagtccttaatagattcaaaattatgttaacagagttttatgatgatatcaccatgagttaggattaaaagaaacaattcaaaacaaagagaggaatagggtgctataactttatttgggcaggaacaggctgacaaaactactcagctgtcaacaggggccatcattagccatttacaaaacaaacaaacaaacaacaacaaaaaaaaaaaaactcagaggagaaaaccagtagcccagagataatcagtagcccagaaggcagagccaacagtagataggaaaaatgtattaggacatccttaccaaggagcataaatggaccctgattctccatccctggagcaagaggccctgaaaatatgtgccaaactgaatttcaaaattgctatggacaagtgattgctatgtgccttccatttctccagtttctaaaggagattttatctactgtggttctcttgactgtatcgttttgtgttgggtatatggaagatagaaaacatgtctttctatatcacagaatcctcagtaaaaagaaactaaaaccaaataatctcataggcatttggacttgatgaagatcataagataatgaaccttgagcctaatgccatgattagatgatattttgggtgtcttggaaaggagtggatgcagtttacatttgggagggatgtgaattgctctaatcagagggcaagttaggactgtttgcaaagatggctgcaataatccttccctacttctatgcatgtccctttgtaatgtggttttgcacttctttttatcaataagtggatggtatttacctacttcatgaacatacattgactttgtaacatgctttgaataaaatacggaagtaacactgtgtagactttggagtctttgtgtcaagagatctttcagcttccactcttgtcctcctagaacactactagccttgtgaagtagccttatcaaacctaaaccagccaccttgataagacattgtgaggcaagagagattatgaagagatagagagaaaagctcagccatctccgcaattatagcaatcccacatgattgctatatgccccacatgaggctccagacacattagtggaacatcttgatccccagggatccaaacaaccaactgtaaatgcatgattgaggccagctgacaccctgtgaagtaggagaactgatcatgcgtgctgagcccaaattgccaacccacatgactatagtcaaatagataactgttgtcttaagtcctggacaatttatttaactttctcagactattatttcatctgaaaacaatactatctatcttataaacagattgtgaggattaaatgaaataatttacaaaaacatttagtctatacatcctaagcactgaatatagggtatctaataatgtgaataatgataacaactataacaatgacctataatattacacatgtccaagacagtgatttagaagcagctttggattaagaccagggcctcccaggccaaagtacctttccccacactacactgcttctccatatttgttagatttttttctaacgtatttatttacttgtggaaaacaacaacaacaacattttattttaaataattcatttatattaatattactcttatttattccatgatgtatcagagggcagaactatatataaaacatggatgaaatttatgagaagggtgatatggggtcaataaaaggaacatatttctaaaacagatctttctacagtcatacaggttatattgccttaaagatgtagtatattccttgtcactaaaagcattcaagaacaggttacatttcttctctcaggactaccaatacatgcagttagaagttaggccagccgatttttacgtatcttcttaatattgtgtgatacttgccctgttttctcaaaaattctctgcattttaaaggcttatacaacaatctaagtcttaaaccacaatctatacattcagaaatttcactgacattttcatttttagacacgtatagatgcactatagaaaagcaacatagaatatgaaaattttttaattggccttttctccttcgattgagatcaatactcaaaacattcaattcttttatgtgttaactgtctgttcatatactgggaaaaaaataaactcgatatgctcttgccaaaaaaatctatgtattcatttatccagcgaatatttatgaaacatttatcaagcctctcctatacattaagctttgtgctatggggtataaggttgtgttttacagaaacagctacataaatactttgatgccaaaaaaagaggcttaaatattttcagtctttacttcttagcattttataagagagacctattacatggatacttatttacctaatttgatacttattaaaacaaaatctattcatttgagatattttcataattaaagttaatcacaagttaatctatgtatagaaagggcttacaagtgaagtgaactgttgcttgggtttagatttgatttaggatagaaataaatacttcttagtttatttatctgtgcagtaataaagctatgcaacttgcagtttcatgttacagatttgcagtatataatatgtagctctccaagagaacaaaatttatggacaaaattaatgaaaacaaaatgtttttatctacttcctatcaatataatgtgaacacaggtcaaggggttattttatgtgaagtccaaaccatttctaatattccctcttaaacagatcacttctctgttttgtcatgataatttagctttaatcaagcttgacagatcgatttctctcccacctttcaaaatttaaacttggagccgatatacatttgtatagaaaaatgatttcataactatattttaaatatgactttactatctttataaaacataaatagaatctcaagaaaagcaaccttgttattttgaaacattcttggaaagacagatttgaagaggaagaatatagttaataaaagccatttttgatgttatttaacacaaaagcaaacagatcttttcatatttgacattaaaaatatgatcatttgcctttctaaagaaagcacatacagcttttatatagactgcacagtaaagaataataatatttctgtttactgagatatcaactggcatttcactgtaagtcaatggtctatcggtgctacagcatattagacctcaatctggcatctacaaatgtcaagagtataaaatatatatatatatacaggatgaaaatcaaaagcatgttccaaactcccaaaaaaataaaaaaagggaaacaaagttcacgcaaacatatttgctgcagaaatcagtgcaatattcagctgtcaatccagaaaaacaacgagggagccacactgtcagtaggacaggataataaaatttctagcagatgttcagtcagggctctaattttcaccgaactcccttggtaagcatttaatttctttatcatatgcaagcttggcaaattgtacttcatcaaaattgtattgtgaaatattaatatttcatatgataacaaaaccccatagaataacctttgtcatattaagagcatccaaatttcaaatgtcaagattctgaattttaattcattttaaatagattcttcaattgccataataaattataataaggctaatctaaattggtatactataatgtcaccgaaatgtatagtacatgtaatattttaatagacgtctttagtaaaaggctgtggggaaataagtatgttcatactactgagttgtatactaccaacatttcatcaataggaaagcatagaaataagaaataagcacatacgatgtaattatatattcacaaatttaatcactaattaggaaccagataaggaaacaaaaaaagtagacctctatgaggcaaacggactactctgcaaaatcacgtatggaaaataatcttttttgaaaatggcattacataagcccaaggtggcttcattatttttgtcattgcaatttgcagaaatatgtttaaaatagtctgcacaatattttgttgtacccaccatcaaagtaagtaaaatagggtttccaaaaaaccccgcatggttacatttcatgtgccaaatttaatttccatttgttcataactccccttttgaaccagcatcacacacttctaaattgatagattaaattcaaattggaggtttagaaggaagttagcttccacatttatttctgctggtgatcctaataaaggcaagtgctcctaggttactgaaagacacagcatcacaaatcaatgcatgtcaccaacagtgtaaagactgatgtctctgattaatcagaattcaattattgcaagcgaagaaaacatcaaattcaaagcagcaaacacctctttttttcagctataattcttcacctgtgcccaattagccacctatttcggtttacatatatgttttttaatagcataactaatatagtcagtatatgctatctgagactcagttttctccaatagattaaacatttgattacagcttctcagtaattcttaacgaatcaattgaaacaaagacaaatatactatcaatattctacaaggttataaacaattgattcatggtattctaaagctgaatctagtatattctgttacgcttcacactttgtttaataaaatattcagttgatctatttgaaaaaataacttctctttaaatataaaaaatctttacgaaggatttttttcctgcactgtttttttttctgacttttgagaattctctagattttcctgaccacacttacacattgcatcttgtaaagctgtcagagtaagacagccttaatgttttagccataataatgccagctattgatcctagtaagaggaaaaagagagaatgtgcttaatggggcatgtttgttctctattattttctttgcctaaggataaagctgattcaaataatgatactcttttcttagtcactaaattcacacattcatatacattaattattactaactaccagttagtattaaatacattgagaggtttagcatttgtaatttatcaataaatggtctaaaaatgttaaagtctgttgttcttttctaattcaaaaccatataaggatgcaatcctcttgtataaagcatcttactttgaaaacatgcatttatatgctttgtgtactttaaagactcaatctcaactttaatacgtagtttatttcctactaagtataagatgtccacttctggttaagtacaaagtcataatgttaaatgaaactcagggtatttgtttttgagaaaggtttctgtattccaaatttataaagaatctatcttatcaccaataccaataagttacactgagattcttttcaacataaattgaattccagaattttgtgcaaaccaaatcaattgtgtccctatctttgagctgaggcatccaaaaataatgaaacaattaataatacaaaaataagagtttgagattattaaatgaaaaagtcactttcataatatttatatctttgttgcttcctagacaatactaaatgagcaatatatgcctgccccttcttccatgggacagaaaggaaggaaagaaactaaagattaatgtgtaatgataggtcttgtcaaatagtttaataagtagtatttcttagtaaaaaaaatccattataatgtttataccttaattaaaatatatgatagacatttctatatgacttcaataatattttcttaccttatcaagagagaaagttttggtgagggcaaaaccccatccagcttcaaaagctcttcgaatcattgatgtgctggtggctggagttgcgctagcaagaccaaaaggatttataaacttcaatccggccatttctacactaatgtccaccagatcaataggagtgtaaaagaggggtagttcaggcttggcagaaacggaagctccatattgtgactgcaaaatacaaaccaatacttggtttcatattacatctaaattgtccatataatattttaccaaaaaaatcacttcaacacagcatccgaattaatatagattacaacagtctgtttacaatgaaaaaaactggcaaaaagtcagtgagcagtgaactgaattcatataatatggccttttaatttcaaaggcagtatgaagagtactagcagaaataaaatcaattaaatcaacaaacaactgtatttaaaacatactgagattcaaatacaaaagggaataattttagaatttttctccctggtccaatccagtctctttgtacttaagttatgaaaatacctttagtgctcagagatatgggcaacggcaagtcaggaggcctaaattcaatttccagtaatttcactactgtttaggcgattttaggaaagggaactaataagtccctgtcttttcttctctatagttttcagtatagcagcaggaatgctgcttgcctaatttctacctcacaggaagactggaaaattcaggaaatcataagctgcagggagacatttaatttggaaagtgggtagtgttctcatgcattacgggggtttgttcttttttctgaaaccaaataggtcccaaatagtttacgtcaaaatcttcgactggcactcaaaactgtaaatttacctttgttaaatgatcatggtaataatgcttctttgcaggattattggaatgatttaataaaaacacttactcttagcacatggcacactgaaacatcatacataggtgcttgctaaatgttgtctctttttctgactggggaggttattaaagattgcatcaggccttttgtttgtaaagtgtctctctcactccattcctccctccccttctctctctctatctccaaaagacaaataacattggaaaatataaaaaggatgaattttctcagccaaagcagttactgaatggacagggctagttaattcaaaagtagaaatccattctcttgtgaatcatcactcaaaagaaaagttatttgagcagaactttaattttataggagtgtgtcttgtgtagataaagatttccatgacttgcatagaaattatttctggccctccaccacttacaatgcaaagcaaagttcacttaatatgtaaaaaggcatcaaacttgtcaattgaaacactaatgtgtctctggtacatgcaaagagatgcctgatgggatccaggcttcagctatggcaggcaccttctcccagggatgttctgggcttcaaggcacatttctgaatattggttagtctgggtgtgaacataatttttctgtcctcacacaggattgctatactattaaaaggattattagcaaatacaaaagctacaatgtaaaatataggaaattggaggttaatttgaggtgtgtgtatgtatatctgtccacgcatggatgttaacaatgacaaaaactggcaaaaagtcagttagcagtaaaccgaatatatacgatatcatcctttttaaatttcaaaggaagtatggaaagtattatcaattaaataaacaaacaaacaactttatttaaaacatactgaaattcaaacacaaaagggaataatttcagaatttttctcctggtcccactaaccagcctctttgtacttaatttatgaaaccttgcttgatggtattttcttagctttgtgtaatcataatgtaaattcaatcaagcaagttttagggttagactaaagaagaatttcctgacactacaggttgattaatatcagtaaaagtatagaagcaacttctctgtcttagaaacaatgttgagccaacttgcctttgatggcaatagcataactacatatggtcccatgtgtctgtactttacaaggtgaaataagtgaacttacaagtattcttctctttttatggctgtgtgttgaaatatctatttttttcaatcttacagatgaattttggtttgttcataattgtagctatatatggcattaggcaacagcccaaggaggcagatatatgtgtagttcaacttgcattgcttaatttatgtagttttaaataaataagtaattgctttgaaattcttacgaacattgctgccttaatacttagaaagaaaatgatttggacacattttgcaagattttccttaagcttcaaaacaaaacaaaaaccaaacacaacaaagcaaacaataataaaatacacacacacacacacagacacaattctttcaaatgagaaatacagcttcttatatattttttcttttattcacaaaagtgctactatgtatatgtgtttataatataatctaaaatcttcacttgtcataggcagtcttttttcatactgtgcaacacagggctatttttagctttgtctttgtcgtgctatagcaactcagtctgttcagcttcatcatatatccaagccctaatgtacacctccttttctgaattttaaaagcctgttccccctctgtacccttgctcagagaactcaagcatatctactttcagctcccatcacaaggttaattcctcccaaacctcaattgcaatctccaaactcagatttccaagagacatcaaggcctttggatgtagatgctttgctcttacactttaacctcaactcttttatctcatcatattccctcctaacaaatatgttatttagattttcaatttcagaaaatactatttttccattcatccagtagtgttagtaaataacagatataaggaaacaacctaggtgttgaacaatggggataggttccataatggctatattgtaaaaaggaatgctatgctagtatcagaaatgatacagaagaaaataatttattgacatgaaagagggtttattatgtacaaagtaaaactgtgagttaatattataatattatatgtaaattccaagtttttggtggaaaaacacatatatctattttgctgtacgtttctgtttatccatcaatcacaaaagataaacatcaacatgctaggagaattacatctcagaatcagggttttagatgacctttaatttttaaatttttgcttattataattttcatattttcaataataaatacaagttaattgagatagatttgaaggtaaactaaaacaatttttaaaagccatgtgtgttagttcatttttacactgctgttaaagacatgctcaaaactgggcaatttacaaaggaaagaggtttaactggacttacagttccacctggctggggaagcctcacaatcatggtgggaggcaaggaggagcaagtcacatcttacatggatgacagcaggcaaagagggagagcttatgcagtggaactcctctttttaaaaccattagatcttgtgagacttattcactatcaggagaacagcacaggaaagacctggccccatgattcaatttcctcccaacgggtccctcccacaacacatgggaatacaagatgagatttgagtggggacacagtcaaaccatatcatcctgatactctaaaacccattaagtgaagctcaaagtaaagagcctgccctttagtttcctccatagagtgtcctgaatcaactttttcagttctatgtattattatgtagagctagaacaatcaaagagactatctactttaaaagctttattttacaaagagaaaacaaaagccaaaggaggctaaatgaatatctgtaagttgctcagttactggtaaagccacaataaaatatatagtttgctgtcttgttggcttatgttcttaagccacccctcagaaataaaatgtttcaatcattgcttctccaaaatactttgtgcctccctacctctgcacttttcacattccatctttcttctccatctgctgaaaattacccattctaaagtccttcccttgtcattacagagaaattattttatctgagacacttatagatcataaaaaatataattattttaattaattacattgaaaatatttggttatatgtttaagtattaaaatgcattaacttccccatatttttcaggaaaccaacttaaaatttctttgcatggcatagtctgatttttttataacatagtgccaatatacctgttagactcagttattaatgttcatatagaactattttcattcatttacttattcagcaggtatttgttaagaacttggggttaaaaagatgaacaaaacagacaaggtctctgacatttatatgcaaaaaaatacaaataaatctaccacctaccaccaaataaacacaaaatttaaactaccaatagttcatcacactgttacatgtattttacctgcctaaaatacaaataaatctaagactttactcatgcgttaaactcttcataatccttccaaactcaactgattcattcaagcatatacttcttgggacatttccttactaccacctatacacttttctgaagtagttacctcttttttatttactattccacaattttactttagtattattctttgagttctgggatacatgtgcacaatgtgcaggtttgttacataggatgctatggtggtttgctacacctatcaaccagtcatctacattaggtatttctcctaatgctatccctcccctaaccccccactccccaacaggccccaatgtgtgatgttcccctccctgtgtccatgtgttctcattgttcaactaccacatataagtgataatatgtggtgtttggttctctgttcctgtgttagtttgctgagaatggtggtttccagcttcatccatgtccctgcaaagcacatgaactaatcccttttggaggctgcgtagtattccatggtatatatgagccacattttctttatctagtctatctctgatgggcatttgggttggtttcaagtctttgcaattgtgaatagtgcttcaataaacatgtgtgtgcatatctctttatagtagaatgatttataatcctttgggtatatacttagtaatgggattgctgggtcaaatggtatttctggttctagatccttgaggaatcaccacactgtcttccacaatggttgaactaatttacactcccaccaacagtgtaaaagtgttcttatttctccatatcctctccagcatgtgttgtttcctgacttttaagttatcgccatgctaactggcgtgagatggtatctcattgtggttttgatttgcatttctctaatgaccagtgatgatgacctttttttcacatgtttgttggctgcacaaatgtcttcaaacagagagccaagtcatgagtgaactcctattcacaattgctacaaagagaataaaataccaagaaatacaacttacaaggaatgtgaaggacttcttcaaggagaactacaaaccactgctcaaggaaataagagaggacacaaacaaatggaaaaacatttccacggataggaagaatcaatatcatgaaaatggccatactgcctaaagtaatttacagattcaatgctatcccaatcaagctaccagtgactttcttcagagaattagaaaaaagtactttaaatttcatatggaaccaaaaaagagcctgtataaccaacacaatcctaagcaaaaagaacaaagctggaggcatcactctatctaacttcaaactatactacaaggctacagtaaccaaaacagcatggtactggtaccaaaacagagacatagaccaatggaacagaacagaaccctcagaaataatatcacacatctacaaatatctgatctttgacaaacctgacaaaaacaagaaatggggaaaggattccctatttaataaatggtgttggtaaaactggctagccatatgccgaaaactgaaactggaccccttccttacaccttatacaaaaaataactcaagatggattaaagacttaaatgtaagacctaaaaccataaaaaccctagaagaaaacctagtcaaatacctcaggacataggcatgggcagacttcatgactaaaacaccaagagcaatggcaacaaaagccaaaattgacaaatgggatctaactaaactaaagagcttctgcacatcaaaagaaactatcatcagagtgaacaggcaacctacagaacaggagaagatttctgtagtctatccatctgacaaagggctaatatccagaatctacaaagaacttaaacaaacttacaagaaaacaaacaaacaaccccatcaaaaagtagatgaagggtatgaacagacacttctcaaaagaagatatttatgtggctattccacagtttaaaatatgctgctactcagctgtcatcatagtcggctgtacatgttaattttctcttcaaaaacaagctccttgaggacagtgaccaaacatatcttaaccaaattattatctccattgcaattaaaaatatgcatgtatgtcgggcgtggtggctcacacctgtaatcccagcactttgggaggctgaggtgcgtggatcatgaggtcagtagatcgagaccatcctggctatggtgaaaccccgtctctactaaaaatacaaaaaattagctgggcatagtggcgggcacctgtagtcccagctacttgggaggctgaggcaggagaatggcgtgaacccggaaggtggatcttgcattgtgccaagatcacgccactgctctccagcctgggcaacaagtgagactctgtctcaaaaaaaaaaaaaaatccatctatataaaatacttattcttgaaggcaattctttcctctgtagagatataaataaaatcaccttttcacatggcattcctcaagtatattttgcagaactaacatatacttcctacatctcctttttttctctaggctaaacatttttatctttaataattatttttaatacaaaatgcttttagtattctagttatcctttgtcagatatctcatttacctatatgctatgaaattgaggaatccgctaacatagttgaaaaggttaaaaatgagaactcgaatttttgccatttccctccctcccttcccattgtaaagcaagaatcattttataacctggacatcaccatgacctctttgattgttcaaaatacactcaatgaaaactaaagaaaactacaaaaggaaaagaagctgaagtcctaaagaactgagatgagaatggtaaaaatggagattaaggaaaagctaaatgtccaagttttagagtgtaaagataaagagcaacctttcctttttagaagtccttcctagacataagaaaaattgaaaataacaaggatgtttaaagactatttttttaaagtttgctttcttcacccttagaatttttggggggagactgagtaaaggttttattcacttacaataaaatttctaaaaattaactccatgacaagtatagaccatcaggagccccaaatatatatgcattacacttaatttttttcatttcattgtcatctgcaagttccttcaagcttctttactacatacagaataaagcagaacctcagcattatataatcccaattgtgatctgggcccttctccctccccgccctttctaatctcatctcctatccctccttcaaaatattttttgcttccacttattgaactagttataatttctcaaataaaacaatatcattaatgcatctttgcattttgcctttcgttttttgtttttgcttagaatgttctttcctgccggtgttaatgctttgaaaattccaactaagccttcaaaagtcagtcctgttgtcctctccactaaaaatcctccttatgtgtaaaaaagggagacagagggggaaatgataaactatcatttaatgcgtatagtgttttagttttgcaaggtaaaaaagttctggagaaacatgatgtatgtgcttaatgccactggaactgtacacttaaagatgtctaagatggtaaattttatattatgtatgttttatcacaatttaaccatgaataattattttaaactaaaaaaaaaaagtctagtaagcctcttgacagaagataccgcaaaggtgtcatgaaggccaagggttgaagttttaaaacctaaactgtgtaacaggctctgtaacggggagaaacccaagaaacttatggtcaagttgaaactcacaaactgcaggaatatagtcattggggtcccttagatgcagaaaagaaaattaactacagcgagttatgtttgtatttcacataagaaagaattttgaaatagagttgtccattaggggtagggtctgtcctgggagatgtgagctcatttccattggatatgactcagattatctattagtcatgccatgggtgtgaagttggagctagataaactttaggatattttccaagccctaattccatgactttgtgattattatcgccataaactctgaagtcttggctgggcacattttccacaaggggcttgtggtaaagtgtagaacaacgaactcagaaaaggcctattcaaaaatcagaactagtcatggtctaagatatattcccacaaagttctgaggccaagataacttaccgatatataacccaagaatatttctggatgtttcagttactgagcatccaggaagcctcacctctggacattgtgtgctaatcatctcttctttctttctttttttgaaaacagtctgtatccatcatcaaacacccctaggatgttatccttcttgatggacacattacagtttattcaggatataatttacacccccaaatttctatccctaactcagacctctcctctgattagattgttgcaatcagttggatatttctgatttgtattttaaacttattacacttgaatatttattaggcattttaaactgaaaacccctgacgcaaattttctgccatcaaacctgcttcttctacagccttgcccatttcaatgaatggcaactgtatccttccaatacctttggccaaaaaccttacaatcatttgtgccttttcttttacaccttacagccagtctgtcagaaaaatctattgtccctttttccaaatatattacgtttctcatctccactactacctcctggtctaagcatggttatctctcactgaatttaccacaataacctcttaactcatccctttgcttcatgtctcagtctttcgcagcacaggaatcacagtaggctgatgattcctactcaacatttatggtgagtgattgtggtgatggttgcatgactccatacatcagtcaaaactcatcaaatggtataatggaaattggcaaatgttattatatacaaattatattgcagtatagctgatgaaaacagaaaagaaagaaagaaaaaaaaacctcctcagcttcccacaagcaaagctgcttcctaatcgtactctgtacttatttgcttacatatatgctatctcccgcttgatttaatttcagcacctagcataagacttggcagagagatactcaacatatttactgaatgtattagactagtgaccttgggtacttagtgtctttttcaaattagtttccagtaaggtgataatcagtttagatgaaataatcattagctttattccaaatctataaaagcccattattctatgattctaacatagagtggcattgaagctctggaagattgctgattttaggccagtctctccaagagccatctagtgggaagagtaagtaattgccctgggtaattagagagagagagagagagagagagagagagagtgtgtgtgtgttttaggccagtctctccaagagcatctagtgggaagagtaagtaattgccctgggtaattaagagtgtgcgtgtgtgtgtgtgtgcgcgcgcgcgtgtgtgtgtgtgtgtgttttaggccagtctctccaagagctatctagtgggaagagtaagtaattgccctgggtaattaagagtgtgtgtgtgtgtgtgtgtgtgtgtgtgtgtgtgtgtttctataattcagtcacattaaatgacacaaagattcaccaacatcacacttttgccaaggtcttgcctaaaatagagcatttttctccctactggaattctgacttccaatttagaatgaactcctttggtgggaagtaatgaattggcctcagatacttatcatgagttacaggaagatctcatgaaactcatgcagaaatgcagccaggcctccaggaagagctgggaattctcgaggaaagtaagaagatttttcgtgctttgtcctctttctttctatgtacagctactttattcttctccctcttccaattggctttctctacttctttatccagaatgattaatattgtgtaggtctagaccagtaattttttactctacttaccagaaacacgtagagagttttaaaaattatgatgtccaggccaggtaccttcctactaattatatcagaatcccttggagggggactcaaataatagtatttttaaaaatattttaaaaatccctccaagaaattacacagagcattcaaggatgaggtcacttctccagtaacatgagttcttttcctagttcctaattatcaagtaagagattcaggcttggccaatattgtgttaggtgtctattttattcaactacgtggctactgggggtctgttcaagagaacagaccgtttaagttcggaagatagtctaaaaggtgctcatgtggacctctcatctgctaataaagtgtcagctctgacaagcatcaacacattgtccaaatgttaaggtctactgtaaaaataggacagttaaaatgtttttctattttattcttaaaatcaacaagacagttgtccatttgcaagtaatatttataccagatccagtgataagtattttttaatcacgatttttaaggtatgcattattctcctattgaagatgaggaaagtgaggcccaaagaaagtaaactgcttgtccaaagattaataagtggtagagcaagacctgaattgaaagtttacacaaactacattatatcaaactgcccccaaccttttttttttttctttttttttgagacggtgtgttgctctgtcgcccaggctggagtgcagtggcgtgatctcggctcactgcaagatctacctcccgggttcacgccattttcctgtctcagcctctcgagtagctgggaccacaggcgcctgccaccacgcccagctaatttttgtattttttgtagagacagggtttcaccatgttggccaggatggtcttgatttcctgacctcgtgatctgcctgccttggcctcccaaagtgctgggattacaggcgtgagccaccatgcccagctgctgcccccatcttacataaacatgaattttctaaattattaatgtcctcaaaacaagaaactaacctaaaaagttattcatgatggtttgattgaacacacagagtacatatacacacacattgaaaaatcttatcaaaaataaaaaccataccctattcaaatatcattaagacaatcataatgccattaaagaatagaaataaaaatacagtcaaactataataacccattattttattattaaattattactctttaccactggtttcctctgttatacctcgtggggtcatggaattatagcagagacatttggatgtgtaatgattatgttgttgggaaaaagtaactcacatggtaagtatacatcccagtggcattttctcctgatttgctttgctagaatgaaatttggaaaaaaaaaaaaaaaaaaaggaagagaaaagcactactaaaagcaatactagtggtagtgtttgttatatttgattgaagaagaaatcaccatcactatgttccatgcaattcaaaataatcaaacagctttcacttagtcattttgtttatatttcattgtgatatgctacaacgggccctatcttggagtacagctgctatagaaacatccattctgaaattattttaaggaaaagaataaataacattgcatagctgcttgtggctagattaattcacagactggattaatgcattaataattaactcaagatcagttccttcgctctttgaagaaatatctattgagggaaaaatcttacagggtaaaaattaatttggattagctgtttccatgatggaaaggcctagctccagtgattacaattataatataaaaacagatttcattctccattttgagaaattattattcataataaaatttccttctgatataaaatcttttctgatttgaggcttcagaagtttctacaaaataatgattccattttacgcatttctttaaaagactgtgttcacattcttctatacttgtaatctgagcataaaataagactagaaaattaaataatattaattggctccatggcataatggtcagcatatctggactctgaaaattaaatgatattaattcaaatccatgtcccatctttctccatctaaactctacctctacccccaattatcagctctttagcaacttaatgtagtaacatgcaaaaactcctcctccttcaacaaaaaataactattcctccccagttttcccccatttactttatgacactaccatccatcaagcttgttaaaacctgttaattgtattatttttgatatttcttctctctcaaatcccatttctattctacagcaaatctaattatttttgactccattctctttgccactattatctcttactgagactttttcttactgacttctgcattctccttgcctcctactcaaatctgttctttactctgtaccagagtagggtttttaaaacagaaatttgattgtgttatgcacctgcttaaacttttcattagtttttcattggattttgttaatattcaacttttcatgatagcctacaagctctttcatgatatggtcctgtctgcctatccaaacttaccttatgccaatctctataaatatacacatcatagtcacatgtgccttctaccaaactctgcctttaactggacatttacacttgctattttctctttctgatgtattctttttccatacttctatttccttgtaaactcttctcccactgccacgtaccagctctttagcaacctgaggtagtatcaccaatgagccaagtgaacttgtaaaatatgcttcctaaaccccatttgtcccatgatctaaaatatttccttagcatataaaatttatctatatctatcaagtgcattctatacggcaggcattctgtccaggtgctaggaacacaacagttaacagagtatcttttctttcttttttaaaaaaagtagtctattttatttattaatggttaaaaaacggcttcactaaacattgttttgttatttaaatattaatatgctgagagcagtattattacacacctttttttccacagccttattgaggtacaatcagtctacaataaacataattaatgtataaaagtcagtgctttggatatatgcatacactcatgttactatcactacaatccacgtcacaaacatatccatcacgttcaaaagtttacttgtgtccctttattgttgcttactttatcccttcctttttttcttttctctttctcttttcttttctttctttcctttcttttttctttcttcctttcttttctttcctttctttccttctttcccttcctttctttctttctctttcttctttctttctctttttcttttttccctttttctttctttcctttccttttctttttctctctcttctctctcccttccctcctgtcttccctttccttctttcctctttccttctttctccttcctcccttccttcttttcttttctttctctttctttccttctttacttttcttttctttccttctttctttccaatatacccagcatccctctcacccatctcctggaaaccatcattctattgtctatttctatacatttgactaccttagatgcctcatatagagggaatcatgcagtatgtgtccttctgtgatggccacttcatttggcatgtcttcccggtctatccattctttcacaaacagtacaatttctttcttttttaagtctgactaatattctcttggatgtatacatcagaatttctttttttttctttttttttttttttttttttgagacggagtctcgctctgtcacccaggctggagtgcagcggcacaatctcagctcactgcaaactctgcctcccaggttcacgccattctcctgcctcaacctcccgagcagctgggactacaggcgcccaccaccacgccaggctaattttttgtatttttagtagagacgggttttcaccatgttagccaggatggtctcgatctcctgacctcgtgatccgcccgcctcggcctcccaaagggctgggattacaggcgtgagccaccgcgcctggccattatccatttatctatcagtagacatttaggttatatcttggctattgtgaataatgttgcagtgaacatgtgggtgcagatatctctttgagataatgatttcagttattttagatatatacccagaagtgggactgttggatcatatgatagttctattttaaattttttgagaaacatctatactgttttctatagcagtttcaccattttacattgcaccaacagttgtataagggtttcaatttctccacaaacttgtcaaacttttgtttttctgataatagtcattgtatcaagtgtgaggtaatatctcaatgtggttttgattttcattttcctgatgatcagtgataagcattttttcatgtacctgttggccatttgtatggcttgtttgaaaaaatatctattcaagtcccttgctaatttttaaaattggactatttaaatattttgctattgaattttaaaagtttcttatattttttggaaattaactgctggttaattaatggtaaatatttcttcccattctaaaggctgctttattactctgttgattgtttccttagctatgcagaagttcttttagtttgttgtaatctcacttaatctccttttgcttttgttgactgcacttttggtgtcatatccatgaaattattgccaaaaccaatgtcatgaagcttttcccatatgcttccttctaaggagttttagagttgcaggtcttacattttagtctttaattaattgtgagttaatttttgtctgtggtgaaagaaaacattccaatttaattattttgcatgtacatagccacttttcccaatgtaacatttattgaagagacaatcctttccccgctatgcattcttgactttcgtattgaaagtcattgtatatgttgtatagttgactgtacatgacatggctgtaggatataagctctctattgttccaatgctctacatgtttgtttttatgccagtagcatactactctgattattgctttgtaattattttgaaatcaggaagtataatgtttctagctttattcttatttaaaattgtttttgttatttgggtattttgtggattcatacatattttaggattacattttctatttctgtaaaaatgtatttggaattttgataaggatttcattgaatctgtacattgctttaggtgaaatggatattttaacattagtttttccaatccaagaatataagatgtctttccatttagttttgtctgctttactttctggcagtattttagagtttttattttaaaagtatttcatgtccttgattcagtgtattcctaagtactttattctttctggtcttattgtaaatggatttttttcttaattttttggatagtttattgttggcatacagaaacacaactgctttttgtatgttgatttgaatcctgcaactttactgaatttgtttattagatctccagtttttgtgtgtgtgtgtgcagttttcagggttttgtatgtataagatcatgtcctctgcaaatagttaatttttcttcttgttatctgatatggatgccttttatttctttggtttggcatatggtttttgcccatcattctgttaatgcggtgttatcacatttattgatttgtgtatgttgaaccatctttgcatcctaggaataagtcttgctttatagagatttataggtcatagaatatgatctttttaatgtactgttgaatttggtttgctaatatttcattgaaagtttttgcatccatattcatcagggatattggcctgtcattttctttgtttgtggtgtctttgtctggatttggtaacagtgtgatgctggcctcataaaatgagtatggaagtatttactcttctactttttacaagcctttaggaagaaaggatattaattcttctttaaatgtacagtaaaattaacctgtgaagccacctggtcgtaggctttcctgtttgggttggttttttattactgactcaatctccttatttgttattggtcttttcaggttttctatttcttcttaattctgtctttataggttgtatgtttttaggaatttatccacttcttctaggttgtcaaatttgttcataatagtcccttatggtcttgctttttatttctctggcattagttgtaatgtctcctgtttcatttccgattttatttttgaatactctttttttttcttggttcagataacaaattgtcaattttatcttttgaaaaacaattcttaattttgttgattttgttctattgtatttttattcattttatcatttattcctgctctaatctttattatttccatccttctgctaactttgggcttagttgttttttttttttgttgttgttgttgttttgttgttattgttcatcgatgtttaaagttaggttatttatttcagatcttctttcttttgtaatgcagacatttactgctataaaacatctcttagtactgttcttgcattaagtttttttttattagtcttttggtattttgtgtttttgttttagtttgtcctgagagatactctaatcctgcccccatgattcaatcaccccccaccatgccgcacctccagcactggggattacaattcaacatgagatttggtggagacacagatctaaaccatatcactgaactacagtaatatgttggtttctttcacattctactagttataatattatctgttaatataatagcatgtagactattatagcctctactgcatacaaaccaaagagtctgttcaaagaataaaacagtaaattaacttcaagaaatgactttaagttagacagagatccccctaaaataataaataacatgttgacaaattttcaaaagtgtcaatcaaaaaggtaacaattgccatactgacaggccccggggcaaaggtggtgatactgctgacaagatgtcaatgactaaagtaataaaaacatggtgaccagctcagggtggtgcctgacagcaaatccatgtaacataaaggagtcagtatgatcaaggtgagagtgacgaaggtaaatcaaataagctgacatttaagacaggtgacagcagtgatgttaaatattaagccttggaataagaagttcaaaattgtaagtcaacaacatatcagccaatacttgctcttgtgttaacctattaacccttatatttctagaaggagaattctctgaaatagactaaggtgaggatagagtgtgaagagaaaaccagcgtagttgcccagaggtcacttcaaaatagaaataacaatatctatagggaaggatggttgtgaagatcaaatgagaaaaactacaaaccccaagcatgctcatttgtatccttctgttcccatggtaactctaccccaccatcaaacaccagatcttttagtagtctaaggtagtatctatcaccactgagccatgtgaacttataaaatccatttcctaaactcggtgtcctcataatctaaaacatttccaaaacctacccattgtttcaattgtatttattaagtgcctacatatggcaggcatttcattggccaaccaccaacaataaggtaaccactgttctagggatacaacagagaacaaaactgattaaaaatgtatttgaaggctacattctcacaggatgttgtctggtatacagtgactgttcaatatatgggaagtgatctaaaatgaaataaggtaaaattttgagtattggttataagaatcacaaaaagtccaatacttgtccccaccctggagcagagttctctgataactggtaggaacttacttatgtgttctgacttccacatgctcagctggaactcaaaaaaagagaaaagaacatcatgaggaaaaagtaagctggttattgaaaagaacagtagaaccgagaacagaaaaacttgggttctacccccagcattgccattaactagttttaacaccttaagaaaggcattacatttttttcttttattttttatggatgttattcttttctttatctctttgaggatatttaacaatttttacaacattttcagataattctattattgttgtattcttctgagtaaattatcttactatgtgaatttactcttttaaatccagttcctcagcttcctaactcatggccaactacatcttaaccaaatccagtatagttctccatttttttaaatgggaaaatggttaatccataggtaattttgcacacaatgtgaatgctaagcctctaaaaacaatcaaccataatgggtattcaataaattagatttttaattttttatatatattatttgagttttagaaccatataaaattataattctgccccttccatgaatgaaaatgatgaggttcaagataacgtattggagattttaaaagttgttaagtccttgagctgggaattctacctctatgatgacaaagttctgtctcagagacataagtgagaaaaccaaaaaggcaacatgatattcccaaaagtctgaaggcagaattactgagcaattagttcacaacttgaacccagactgcttgactttcaggatgccattataccatcctggatattttttgatctgatcctttacagcttgtttgagattcaactttactaaatcactgaattcagaagaacacaattctggtcaaaatttctaactaggttattttgtatttaaattctccacagcaaactaaagattttgggtgttttgttttattgtgctacattgccattagacccagcagaccccatgcattagagcgctgaaaatttggcatgggatgcataacacttctactctatttggaccaattgatactgcagtggttaatttccttaatactccatcaacatgaactaaggttagattccctacgtattggatcagatttttcagttagtttttatttctgccattctaatcttcaattatctctgcctgaagtagcaatctattgctatatgggtaaggaaatattctgtctttatggagacaatttcattttaaattacttttcaggtcaaacactgccatttaataaaagtttggaacctatacaaagtcaataaaaggcattaaaattacttattagtcatggtattttctttctctatcaccaactagacagttttgttttgatagctccattaggtacagcctcattgctcattttttccttgacttccttttagaacatatggatgttacaaaaaataaattctcctttacaaacaaaaaccttcacattattaggaatataattgttaatagaaaaagtgtcaagtatctgatgcataataattatttaaaaatattagctgaagaacacatcacaatttaacctgaatgtactatcaaagaggaaaattatgtggagagtactatagggtttaatgtatgtttatttataagcaactgaagaagacttcatttttctatgactgtaagcaaatttgactttactacttgccattgcgagagataaaggtgagatcacatacatttctggtactagttaagtctaaaggcccagtttcccaatgagactgacctgaagtcatctcaacagtatgatcctgacccagtggaaaaacttagcatggaaacagcatttagccatgacatacttcaatattattttttggaggctatcactatctcaaactaaacccattatgatttaaaactgtctttttattgatattcattgtttttcaacctgacagtggccaatgatttatatcaatcttctcttaacacaggaataaaagagtttgcaacatatcttaaactgaaggacactttttcagtaagtctcaagattttaatacagttgtcatttcaaaagcctacctcttctcagttggaaaggtttagagaagaagaagtcagctctgttgataagattgtttttatctgaagcagtagaggattcaaaaattagtatgacatatcgatgatgccctttcttcaggcatttttattctttaagtgcaagaacactgcagctggctgtcaatcattaaactacaaaatgaaatcctttgcctggctaggagatttgcaactatactgatgctggtaaactaaacaccaaattatagccttttctcttgcctcacccagatttcacaggggctgcacacccaaataaatgcctcttggctacccattcatctaacagctggaaagatgacacttgacatttggaaactttcctgtgaagattgctgcaaggctttcccattagcttcctggtgagactgtaaggtcgaataagctgcctcaaaacctgcaaagggtaacggaaatactctaatattaagcctgtgcaatttaaatttctaattctcgaatcatagttcttcagatattgtagaaatcactggtatatttcagggcaaaagaatgcctttgaagatgtgaaattaaagtgatattttaagcaatgataatgataacaagtgtcttttatttaaagttgggactgaaggtcttctaagtaacagggacttcaacacagagaagttcttgtaagtttgttttctaaaatccctgactgtcatattttcaacaactgttcatctttgtccagagcagaaatctttaacacgaggcagagttattaccattcttcactttttttcccacatcataagcattattgaaggtagctttaaaattcttacaacccagcattgtggattcatttcaaaaattactgcccccaacataaaataaaatagtaaatatgccattattaaaatgctgtcatcttataaaattttcaggtataaacaagccttttttcctcttcagaaagataattcctttaaaatgtccccaaatcagaaattgttaataaaatgacagtttattaaagatagcagaaagacaaaattcctcacataatctcaacccaaaaaagaatgtaaaaaatttcatttattgatatgaatgcacacaattcaattagattttatcacaatgatctttttccatgatactcaatttggaattccatatttttaattgtctttataattgtctgttcttgtttgttaactaagtatttttcaagtgaaagattaacaagaatgaaaaggcttccctaaatgttcagtcatatgtccaaattagatgaaattaatgtcatgattaaaaaggaaactgaaacctttaaaaaatatacgttgagggcattgaagaaatggaagacatgaatgatgtaactttcaatcttgaattcatcatcatctgagactaaaatcactttttaaaagttcaggaccagcctgaccaacaaaactaactgggcgtggtggcatatgcctgtaatcccagctacttgggaggctgaggccagagaatcgcttgaacccgggaggcggaggttgcagtgagccaagatcgtgccattgcactccagcctgggcaacaatagtgaaactctgtctcaaaaaaaaaaaaaaaagtcaatttagtgatgctgaattgtacctcattagcaatggatgtgcacctcttggccccaaatcacggcataaacctagttttctcatgccattccattaacgaatccaccaaaaggaagctcagctcacagaaagaagatggaatatctagcaatgactggacttctcatttctcttcaaaccaaaaccacagctaccatttgtactcactctactgcaggtctatggcatgaatttgtctccactaggtcttgaaatcacacattcatttcacatagcctattgaactgccatcagatggtaatgactttctgtcactcttgacctggggcagatttgaactagtgaccaagaggttaaaggctctgtatctcattaccaatcccctgagatacttagttccctcaaccactagtgattttttttgtgcctcagtcaagccagaagaaaatacacacagaaaaaatctaagcagtagaaaagtaggtcaccaatgcaagacatctatgatagttctcatgaacctaataaacacctatttcaaaatatacccatatactacatgtacctgagtagaatcacagtaactgttaaagaacttcattgtaactttcaatagtatttcacataagctaccattaagctgaaaaacactgcagagaaactgaagatacttgtgcttcatgagcttacagggttaaggaatgtattttagattcagtatcattccagaatatttgtgtgtgtgtcttgtgtatctattctaaaataattctgcctcacaagttagtttcagaggggggttgacaaattggaagaaataatatagattcataaatgaaataatcaaaacattatcaaacaccttaacgtggacacttactataggaatacagcatattttaataaggataaagtttgctgaagaaaacagaagaatagtatttaggaacatatatttaggcaaacatatatatatacagtagtagaaatattgaacctaagccaacaatgaaaaaattaactttttgttgttgtttttattgttgttgaaggttgacttcaaatgctggctgctaataaacaatattctataactattcaacggcaattattctgtacataactaagtaggcagtgactcctgaagtcacttagaaatatgtactcaaattttttttaaatttaatgccctgacgcctccttccttacactttgcattttcccctaaatgtttgattttcatggaatgaatcccacttggaagaaaatagatcttttccttttcatttcttgcctatatttaaaatggtgctctatacaaattattttatttgaatttctacctctacctgttgattccatatttatccttctattaataactcttattttttgtctctcaatatatatatatttctaccacaactgcttttgtagcagcaacatgtacatttagttgttcccttccactactggtaataaatactgtggctttttaaacgttgcatctaaaatatagagaattgaaaacaattcttaataaaagaataatgacacggcaaaaataactctaatgatgtaacaaaccagttagttttgtgattataatttctataaagatcaacattatttgacaaaatgttccatgtttataagagctccttctcaggactaccatgactactgaagggacaatgagcttctgatctgggattataatttagaataatttagtttgtgttctatctccaagttttttctcagtggcaggacaaaacatgatgagatatccatatagcctttttctctccactttttgcaaccaaatctgtctatatgctaatactagaacaaagtaagtgctccgccttctgaatgctgtgtgagtggataaaacaaactcagtttctccactaaaatctcacaacacgcttctgacaccaggtgtgtgcgaactgctccccaccagcaagcaagcaagcaatcaattctgtagtggacacaagctgaatgtcttctaattcagctcaattctgacactatctacctgatgatagcaccagttcctacaggttgagagctcattccccaaaactgccccctaccacttcaaatgccaataacaagccccaggttattttacctgtgcttctgaccaaccagctataaactgggattcccacaaccccttcttcgggttagattaactggttagagcagcttacagaacccggggtggggggtggggggtgggggtggcggcggggcagggaacaaaacaaaacaaaacaaaacaaaacaaaacaaaaaccaaacttttactagtttattacaaagagtattttaaaggatacaaacacaacagtcagatgaagagacacatagggcaaggtctgaaagggcccccagagcagaagcttctgtccctgtggagctggggtgtgccaccttcttggcacacggaagcgttctagtttactttcctggaagcacccccgtcacccatatttgtctattggcaagttctcagaacctagtccatttgagtttttatggaaagttcattacataggcatgattgattagatcattggccactgtcaatcaacttaaccttcagccccttgactctccccggaggttggggagcagggctgaaagtcccaatcctagtcctgcctcagtccttctggtgactagcccctatcctgtagttacctatgggctgtcagccatcagtcaactcattagcatacacacacacacacatactcatcactttggagattccaaagattttaggagttgtatgccaggaaacagggtaaagatgaaaatttcacaatatcaccatgtgtttttataaattagtaacattggatattaattcagtctctatttggtgcttttgtaatgaagaaactgaggtcctctacatgctctcttaaccaagttggttgcatctgacagatttactggactatttccttcccttgttttcctccctaagagacacaaaagatggccaagtaatgctgatgctttataaccagtggtacccctgtatacctacgaaatttctgcttttattagttgagttgtctacttatcaagagtcagctgtatgtttctcgccctgtttctgttggatataaatgtaaataaataaacattaattagttatatggatgcaaaaagaaagaaggttgattctatgaaaactaagttgaatgttcttgaaggatatgataaaaatgagttacttaaaaaatactgctgtcaaattaggtgttggtcaaaccactgaaatgactgcaggacaaacataaaaatctggaaaattgcattgtatgattctcgaaggtcttgtaccacttttaaaaatgaaaatggtagacaatatgttatagatagatttaggcaagatacataatacacatctggctattttatttaaaaacatcttggccctggatttttttaaaagaaaaaggaaaatgagaaaatatctatatgctttaaataaaattataagctttggtcatgtgctgcttatgtaataaataataaaatgatgaggttaatgtatgtgtatatcctttttacagtttcccattttaactttttctgattaaccaacaaagtattaattttggtttcataggaaaagagaaattaaggaattaaactaattaaggaattcatttagctatagtcattctttcagttacaaattctttctttaggtacactgtcaaaattatctttcgtattcagtaattcttattcatttggtagaagaaaataaatatgcctggactccactaatatcacattataaacaattaaggtgaagtcatattgaattattagtagaagtaactaaaaaagtaaatttaatattataacagaatgacacttaagaagggaatttctgacaaactggaaaacgcttttcttcacattaataccagatctgacactaccatatcatttctatacatgaacaattcctaccacattacctactccaaattgaaatcctagctaggcaatctcatcatgttctactcctggtataattactgaactttctctctctcatttttcctatataatctctatattcagagcttccatttgtccaccctatgctttttggtgaaataaaaaggagttgctgcacagtgcaaaacttatggaccaaacagagaacatctttatgaaaatttgaggaaggtactccctcctctgtatagaagcagaacaacaaaaggttttattgtttgattagtggagcttggtctggatttcagccagcttgtaccctggtctgggtacccctcatggagtgagcaacatataaaatcttatccagtagccttctttaaatcccagtaaatctaattacccagtattattctaatttttcttattctttttaaattttgtttcttgttgtttgtgatgtccttgctgattccacatcctaatacccacatccagatggaatcagtcattgtctcttccaggttacctttgtaacttgatgctttttattattgtgttaagtatgctatattgggcttacatttacacaactcacttctttactagacaataggattcttacttgcaaatttaaatctaataattggtgctatctattatatccactactttttaaaatgcatcttttgaatgaatgaattaattaatgcataaatgagattgatggatgtatgtggatgaataaattaatgactaaataaaatgcttttgcaactacctaaaatatcctatttcaatattcatctgttaagactctatacatcagatttctattcaaatttcctatttgccatctttttcctgatctcgttttaacaatacaaggtgaatgatttctaataacccacaacaatggtatacacaacaaatattcacaaagcttagtctttaccaagagctttccatactttctttcataatcttctgcaagacccaagaagatagcagctctaattattattttaagtaataataataatttataattgcttattcacttctataccctggagtgctgaagtaacctgtccaaggtaacatgattggaaagtgttggaactggatctgatgtcttctctgtagttcagagagcccaaatttataaccactatattatactgctcttatttatgcattgtggtaccctcccgaagtcaagtgtgggcccaaaggctattacttaataagtggtaattgagcaaattaactgatgaaatttaagtgaagctctcctcagagaaattgcctccactttctcccaacatggatgtcttcaaacaatcacatttatctgaaaatgcatattacaaagaatttctaaacacccaattgcatgcattaatactataatctgtttataaaatcatattttaaaataagctattcaatgttaccttttcccccaaaacaaactaatgtaaaatataagacaaaatgtcataagccttagttgtgaaacatactatagacattacagaaatttttttaacaaatgctacatttgtgagaaaacaatattatatgctaatgaacttatcatataacaaactcattagttttcttaactcctccttaaatgtatttaagataaatgatttctgcatatttttcctatgtaatagatgaatactttattttgagggtacagcaatacataaacatggttcctagcttgtgcagagacagaccagtaagcaggcttcaaacaaggagcacaaaggaagttcatgtcacaaactccctggacgaggaggagaaagccaatcctgaaggacaagtgggactcaaccagagggaaatgggtgaagtgggggaaaggcccagattcaggagaaatcttggtatgcttggggacattcaaatcagcatctcaaagctaagaagtttggcctttaccttgagtgtgagtaaaagtcattgaagggttttaaatgagctaattaggattcaactgataatctagaaagatgactctggctgcagtgtaggggcattggatttgacaggagagaaagtggaggcaatttcaagagaggtgatagaggccagaactaagttaatgacaatgtggagagagaaaaatcccactttgtctatatgtaccttgttagccttatcgctgcttagcactttgcatccaacaccctggcaggaaggtggaaatgttgattttacttgacagagatttttacctaccttccatctctactccattttaacatgtaattcaacacttagtttgacaagtctgaatccttcaaccaaatccaaaattcttacatggcacaacctttattttatatttcaaacactatcattcctagcaatatgtgtttttaaagcacatgcatgttttcttcattatagctaaaggtctgtttctctcctttctctacacatcagatttctattcaaacttcctatctgccattacatggaagtaaaataatttctttttttttccagtacacatttattagattcaggaagttacaagacaacagtgaaatgaacagaaaaaaaaaaaacattaagattcctttagaatgatattgtgaaacaccaccaaactacaatcataaatatatttaagcattgtttattcattttaatttaaaatctataaatggatttaaatatttaggataagaacaaaaaacaaaatcctccactgacctgtgttcaattttactttttcaaatctttttagcttctctgcccacataccattttcactatgaattcacacattcactgggcttcatctggtctaacacaagaacctcatctcttatcccttgattccactttcatttcttaaaggagctagcaggctgctcagtaagatttctggtcaatcaaaattataactccacacaaaagataaaataaaataagggtataaaagagtttttaagagatagaataagaattgaccagttatatagaaaagagagaagaataaaacttagataagtagttggtaaatacagctatgtaccgttttgtcttataatgaaaaaaaattatgtgcatgttgtatatgtgcaccaatgtaaatcttttaactgtactttcttgagcgtatctcttattctgagactctagcctttcctaactttttcataaagtgtcctattaatttatataaataaatgtcagtttcctttgttctaatattgttattctgtaaaagaagaagccatcagcattgtattgatttccaaatcaatgttgaaattttaattattctgagtaatttatgaggaccactaacttagtaggtttgaacctggaaataaaaaatgttaaatactggagttggagcaagttgggaagaaatgtttgacttaaaagcagtgaatctgaaatgtaggaaagacatttacatgaagatgtttggtgaatatgaaaagtagattagagacacaagggaagatattcagtggactgctggattatgcaagagagtgccctgttggaggtacagattagagagttacacagcaggaggtaagattaaaaactgtgaaactaaaaactgccaactaatagtaatggccccgaaccgtgaagaaagggaatttcgtgctccaactttggcatccctagaaaactgcatgaagctttctcagatggccgttcagggacttcagcaatttaagtctccccttctgcagctcccttacattgaagaggacaatcttagacaggtttctaatcataagaagtataaaatttaaactatccaggatttggtgagtttaaagaatcagattgtcatactctactgcacttccttgaagatgaaaaatatgaagaggttatggctgtccttgggagttttccatatgtgaccatgaatataaaatcacaggtgttagatgatgaagacagcaacaacatcacagtaggatccttagttacagtgctggttaagttgacaaggcaaacaatggctgaagtatttgaaaaggagcagtccttctgtgctgcagaggaacagccagcagaagatgggcagggtgaaactaacaagaacaggacaaaacgaggatggcaacagaagagtaaaggacccaagaaaactgctaaatcaaaaaaaaagaaacctttaaaaaaaaaaacctgcacctgtgctattaccacagtcaaagcaacagaaacaaaagctggcaaatggagttgttgggaatgaagctgcagtaaaggaagatgaagaagaagtttcagataagggcagtgattctgaagaagaagaaaccaatagagattcctgaagtgagaaagatgatggtagtgacagagactctgatagagagcaagatgaaaaacaaaacaaagatgatgaagcagagtggcaagaattactacaaagcatacagcaagaagagagcgctctattggaaaccaaatcaaaaataacacatcctgtgtatagcctttactttcctgaggaaaaacaagaatggtggtggctttacattgcagataggaaggagcagacattaatatccatgccatatcatgtgtgtacactaaaagatacagaggaagtagagctgaagtttcctgcaccaggcaagcctggaaattatcagtatactgtgtttctgagatcagactcctatatgggtttggatcagattaaaccattgaagttggaagttcatgaggccaagcctgtgccagaaaatcacccacagtgggatacagcaatagagggggatgaagaccaggaggacagtgagggctttgaagatagctttgaggaagaagaggaggaagaggaagatgatgactaagcagtactctgaatggaccatagtgtttgcacatatttgcaattttttgctgttttggaagtttatcataaaccagaaacagtacagaactgatgttgagggaggtgtagtttttttactctagaaatgggtgcataatataactaggcagtggcagtgccttggtacaacctgaaaaatgttaaggcttactgaaacctttcaagtatgggatggtgcatttatttcatctgcaaatgataataaatcctttgttattattaaaaaaaactgtgaaattactctgaaaataagagtagaatgagaaaataaaaacaggaagatagtttggggggcaggaaatgcagaaggaggcaaagtagggaaccatccactccctgagtggatagctgtcctttgctgcttcctctgtctgaggcaataaacacttggtaaagcatagtgctgctatctatccttcagtcactgcaaagactggagcctgaaccactcaccaacttgtctcctttgggttttccagtgtctgtctctgtttaaattgtgttctttttctttctttctttctttgcctagcctagtcccttttgatgtataactttttaaagttttaaaattttagatttggcatctccctagatgctatttcctgaatcaaagctttgtctctttgcaaaatccacaggctcctttctctctctttctctctcgttgttttgttgttgttgttgttgtttaaagatgaggtctcactctgtcacccaggctagagtgcagtggtgtgatcatagctcactatagcctccaacttctgggcttaagtaatcctcccacctcagtctcccaattacctcattcattttgagattcctacatttctgggacaccacggtttggcccaacaactcaagccccactactcaaagatgccaaggaggaggtggaagtaggcaggtgaatcaaacttttaaaagatgatactatcagtgtcaagtccaggccctacctagcaaataagtaggtcctgcattagttacacaaacatgagaaggacaactagaatagacaaaatggtcatggaaaagaggaagaaattaaaggaagcattaaagataaagtgaattttgttagcatgtgggaaacaaacaagagaaccaaaacaagagtggtaaaaacaagagtggtaaaaaggcatagtgtgagcactcttccttgaataggaaagaaagaataaaaattttattaacaagagcaaattttccaggaacattttacataaatgaggtaactgtatctacatttaattaaatcacagaacaaaaagaaaacaaagcatttagtcggaaagtaagctactgagatctggtagttacacttttcttcctcaagaccacagtcgttgtggcaaagtatgctcagcttcacatctcatcatttcacattctgtatcctaaattgttaaaaactaaattgttttcaaaaattacaactgaaggctgggcacggtggcttatgtctgtaatcccagcactttgggaggctgaggtgggcggatcacttgaggccaggagtttgagaccagcttggccaacatagtgaaaccccatctctactaaaaatacaaaaattagctgggtgtggtggcatgaacctatagtcccagctactcaggggctgaggcataagaattgcttgaacccaggaggtggaggctgcagtgagccaagatcgtgccactgcactccagcctgggcattagagcgagactttgtctcaaaaaatataaaaaaattaaatttaatttaatttaaaaaataaaaattacaactgaaattcatcaaatgtttgtttcctttccacttaggtgcatagaatttggaaaacagacaggaccttatctggtccaaatgaacagatcaaaccatcttttggagtatgtaagattataattaatgtagattctagtatatgtcctataatattgtataccatcagatttgataagtgtatgatctatgtatttaagccaataataaatattttgaacacatcaggactaatgacttcacagtactcaaatggtaggaatgcatgataaattttctttcttattttttttttttgagacaaggtctctctctgttgtccaggttgaagtgcaagtggcacgatcatggcttactgcagccttgacctcctcagctcaagagatcctcccacctcagcctcccaagaagctcgtaccacaggcgtgtgccaccatgcccatctaattttttattttttgtagagatgggatattcctatgttgcccaggctgatcttgaacaccgggctcaagcatcctcccgcttcagcctccaaaattgctgggattataggcattaggtggcatgcccgcctggcccaatttttaatcaactcaacagttctactacctagtctacattttaaaatttgtatccaagtatgtacgtgacatattgtatatatgcttattatataccaaatagaaatgctcttatagatgagtatcaaaaataaatgaagcacttatccattggaaaagaattaagtggaaatgatggcaaatgcctacctgtacgtatttgtgaatgtaccaagaagcttgctttccatcattcaccgattccactgtagtgttagccaaaccaacgacatcaccacctgcaaatacccatgcttcactagtttgcatagtttctggatctacttctgggagaccccatctgttaaattttatagggctcaaggcttcttttactgaaaaaacaagtgaaaaacaatagacaatcactagtcaacagacaattccataacaataattttaaaattaagaaaaattatggtttaattattgttccagggattcaaacaactgtttttagtaaactataaaaatgaaaagctaacgaaatattggagttaacaacacatttgaagggcactgacttaactttacacctcacatacaggaattaaagaccacagatttggtcaatgtttcagagcggacatttatgtctacgaagtatggatctataaagaaggaaagtacaaccttttaaatacatacaaaatacatttttctaaaactttattcatagccatcatttttacaaatctgttactacttatattatccccaacttgttcatgtgtgtcacttttgaaagttacatcatgaattcaggtcaatggctaatctcccttttacaacaaaacattttataaagcaaaatgagacaacatatataacattttcattaaattatttgcacttactattaagcaatttaatggatctagtatacagttacatttagccagcaatttctgctttgttttgttaaaagcaacaaatgcaaacattaccattaattccttgtggaaattgctctgtaaagtagttttgcaattatttactaaatatgctgcattctaatgaatctaaaagagtcatggaagaggaatgaagctgtgtttctttaagaaaaatatctaacgaacattttgaaagcataatcctgacatgtggaagagatcaatggatgcaatttagagaaagggttgagtaagagaagaaatgaagaaaggtggacaacaccctatttgatggagtaaactgagtaagccagtgtttaggataaaatgttctctccaggtaacgtcataatttttaagcacagcatctcagacagactaagggccttattctttactccaactccaaagagaaaatattagtaacaacttaaactaaaggaagagagcttgggagattttggaacagaaaagttagttgttgaatttatttatgaatcaagtataacacaaaatagccaaatacaaaaaatgttatttttgacacctaaaaccagtttcttctgagtaaaatagaggaaaaaaatagaaataaaataaacactggtatatatttgtagctttctacttaaagaatgttagagttgtagaaaattattgagggtttactgttgattgtgtttttcccacaagatcataggttccatgagaacagcaatttgtccacactgcttgcctgtgttccacagagcacactacagtttttggagcagaggacactcaattggattgatggatgaatgaatgaatgagtagatgggtcaatgctatcatactcaggtttttattttaaaatcttctactgtttctatttgttttttcgtctttcattgagaggaaaattaaatattcatgtaattattttcaaagcagaaaggcattttaaggaaatttttctaatgtttttaaaggtcacatgaaaagagatctttatcatttgttccctgttgcataacagatcatcactaccatctgttgacagttacttgagttgcaagaaagtcaatagtgagtatggctcatcaattcaacctattttaataatggcaactgtaacacatcatcattgaatgatatatgtaatgagctttataaatagtggcaaggggtaaaaatgaattctgttctatcagaaatgatcttatgtttccaaaactttggcctacaacagatctgaaataaagataattaataaaaagataagaaattcaaaattttatcactaggagatcaaagcatttttttttacatttatctcatgtttcacagcaatatccttgaaatttaagtagagatttcattctatgcttgagcaaggtaggaataattccttagttatctctgagtcccacaacataaattagagtcaaagacatgtttacagtcggccctccatatctgtgggttccacatctgaggattcaatcaactgtgcattgaaaatatttgggaaaaaaatagaatgtttatgtctgtactgaacgtgtacatacttttttctttccattattccctaaacaatatagtatatcaagtatatatacagcatatacattgtattagatataccataagtaatccaaagatgatttaaagtatatggaaggatatgtgtagattatatgcaaataatacactattttctataacagacttaagagcatagatggattttggtatccatgggggatcctggaaccaagcccccctagatgtgaagggataactttatcatgaagttactgaagcttaagtagggtccctcacttgcatgggactctttcaaagccctgcgcctaatttcaaatctatgaatttttcttttcttaaagaagagctctcaaattgtatacacttcaggcctcataaaatttgaatcttcacttgagcacagtgaattgtacacaggaggtgctgaataaatgcttcacaaattaaattgaagttcttgaagaatgtgctttaccatattttaggatgcaaaaaatgtacatagaacaattcactttaacactccacctgtcacaaactcggtccataagtagtcaggaaatgttactctgagtttaataagtaactttatgtttcttaaaatatttagcaccaacatcataagccaccctaggggcatttatttgtgaattcaaaagcactcttctgctcatgggcatttctattgtatatgcattgtgttattatgtatccttaaacattcataatactcatgtatacttttaaaaataagctttctttccttaatatttgatttatttattctgtgaagtcttaaacctgaatatcaactgttttaattattttatcatttgtaatatccagctaacctcattaaaaatcaaacaattctttgatactctattctaaaatagaaaaaggattttctttcatattaaaaatcatctcagtctccttttgaaaattaactaccaaatttcctcctgctcattttggagaccttcaagtttaacatgttcctaatttcattccagaaataaaaagaaaaagctgagagatcacacagctggttatgaggttactaacatcaatcaaaatagagaccatctgtatatattttaatacccaatatttggctcatcaaatatctacaaaaagatcactaagaaagtagaatatggacaacatttataaatataagcaatgctacagtgggtcagaaatatttctttcagtagccctaagcaccaagaatgactatcacaactggaatatcaaatggttaggatcatttccttgtacatgtagtagactctaagcacatgtaatattcatatatagtatgaatttgattcatactatatatgaatttactgaaactttgttaaatctggagctaaatacctttcctaatttcaacaattcttttaaaatatagccattattttaattatttaatcattttcttaagcttagaactcaaatcaaggattcagtgaaaaaatccacgtgcatgttattcataatttctcagaaaggaattcatttatttagttgctccttatgaggaagactatcatcctcatcattgtaactgttcttctatgaactcctcagagctcttttacatctctgctgatagatttaacttggaatacaataaaaataaaactcagaagcaaatcttctgttctgtctttacccagcttggaaggagtgaaagcataagtgaatgaaaaatgtatatttacatctgcaaaccaaataactgcttgccatttcctctgaagtgttaaatgaatattaatagaaggattgtattattcctttcttgtttataaaacgggggggattttctgttatgttcatgcacagttttctcagattttccatgagattgcatcttgatggagactgtggcatatgtcccaggagctccatagttgaacagaaaaagaacttgaaaaagaatcccaaaacatgcttattcacagtctatattattctgcaattggaagagaaatttgttaaatgatatggtgcctggaattttatgcagtctttataaagaatgaaaacgtccttaattcataccaaacattcaagatttatgttaattttctgctttaattactactatgttcaaatgagcttatttaaaaaacaaagacactctgaggtagctttataacaagaaacggttttgaaattggaacttttagtcaatttaatgctgtgcatgaaatgattttttatacagacttaatggtattgtgacacacaagttcttcaataagccacagcttaaaattgcagaaaccgtccctcagggacacatcactagcagatgcagattgccaaggtcaattaaactgatgtagctgtgctgtcacatatgtaaaagagaaacccacaagcatatgacaagtatatttctcagtttttataaaaagatgtcaagaatgttatattttagtacacaaatataaattaattctccataaacaataaaacaatacaacagatatcataatgaagaaggattattagtattctttggagagtttgatgtgttataaaacaatggggggaataaaaactttcaacatttacaataaaatgataccttgaaaacatagatgaattcatctatgtccttgttgtttaattttacataacctatcacccactaggaccaaatcacaatgaaactaaaaggtgtgctgaggcagtaatctcagtaattcagcgctgaaagcaaaatctcagcaagatcaaaataaattctaattacaaggccaggatatcagagttctgtttaaatagaataacctggggtaaggaagggccagaaccagagaatgcctccaactaagaatatcaagtctggatggcttgagctttgtcttcacatctcccttccacttctcagtactttaatcagtatgctctccacaatgaagattcattgttttccttctgccagtctctcagaagataaccttgattctgtaccttcctgctcctccaggtcctcaaacactgtctcttactcttttcagtatattgtatgtgtcattttctcctctcctctccaatttgaaaaaaactttgtttttgacatggttatcttttctcactgccattcttatatcttcctttacccaatttctcggtcatatacttggactgcttacttgtctcaccaccaaattattccttgaatgaaagtatggtctccacggtcaccaaattctgtgaccttagtcttcagctcttttgcctttctgtagcatccaacagttgaatggcattaattttgatcttttttgatttgcagaatgctcctctaccctggctctgcttatctttaaactgtccttcttgggctctagcccctcttcacctcttcattttcctcttctcagctctcaaatattcagtccactgcactttctctgtcagaaatcatagtcatttagggccttcaatttcatctctataaagatggcctcgaactctcccttgagttcttccttttattctggaacttctggatgcctgtttaagattataacctgtatgctctaatgtcccttccaaatcatcacatccaaaactcagttcacaagcttcccctgggccttcccacctcatgatttattattggtgaccttactctttcatttcctccactcattgtgaacacgtcttacctttgcttcactcctcaaaacttctatagacttgactcctttctcttgcccccactgtcaggagaaggccttgtcccacaattcacagagaatataaaagccatcacatgggaactctcttttcttcccatcagcaaaactacaaacctactggatctataccttcgctctctctctcttcctttttaataccactaaggaactctccctactatcagaagccattctctccacatgggcccaagaatcctctcctctgacctggtaggaattttgcccctgacactatatccactctcttctctattaccagccactctctacaaattagaggtttcccatatgtaggtacatacatgtacagtagtacctcccaatttaaaaccattccacatctgcatttgactccaaagcttcactaaacctcttttcactgatatgattaattggttccaggtcgccaagtccagtgattcttctcagtgatcatcttgcttcagagcctgaaatagggtgaggtgagtgaggcagacaaagaacaaaatttaaggaggtccttactctcagggtcatgcaaaggcaaagttgttggacaggcacctaaggtgcctcccccttgttgtgctccttgatttctcagcaaaattcaacagataaccacttcctcctcatgaaagtcttttagcctggcttctgtgacatcatactttctgctttccacctgtcctcatgatgcatttttaatagtcattgctgcttttttctattccctttttttttattttattttattatgatttttttcttttttttattatactttaagttttagggtacatgtgcacattgtgcaggttagttacatatgtatacatgtgccatgctggtgtgctgcacccactaactcgtcatctagcattaggtatatctcccaatgctatccctcccccctccccccaccccacaacagtccccagagtgtgatattccccttcctgtgtccatgtgatctcattgttcaattcccacctatgagtgagaatatgtggtgtttggttttttgttcttgcgatagtttactgagaatgatgatttccaatttcatccatgtccctacaaaagacatgaactcatcattttttatggctgcatagtattccatggtgtatatgtgccacattttcttaatccagtctatcattgttggacatttgggttggttccaagtctttgctattgtgaataatgtcgcaataaacatacatgtgcatgtgtctttatagcagcatgatttatagtcctttgggtatatacccagtaatgggatggctgggtcaaatggtatttccagttctagatccctgaggaattgccacactgacttccacaatggttgaactagtttacagtcccaccaacagtgtaaaagtgttcctatttctccacatcctctccagcacctgttgtttcctgactttttaatgattgccattctaactggtgtgaggtggtatctcattgtggttttgatttgcatttctctgatggccagtgatgatgagcattttttcatgtgttttttggctgcataaatgtcttcttttgagaagtgtctgttcatgtccttcgcccactttttgatggggctgtttgtttttttcttgtaaatttgtttgagttcattgtagattctggatattagccctttgtcagatgagtaggttgcgaaaattttctattccctttttcttttcttttttttttttttttttttgaggagtctcactctgccgcccagtctggagtgcagtggcatgacctccgctcactgtaacctccacctactaggttcaagtgatcaagtgattctcgtgcttcagcctcccaagtagctgggattacaggcgcttgtcaccacgcacagctaatttttgtatttttagtagggatggggtttcagcaggttggccaggctggtctcaaactcctgacctcaagtgatttaccagcctcggcctcccaaagtgctggaattacaggcatgagccatcgcatctggtcccattcccttcttcaaaactaaaaatagagcttacaaatcttagtataatccatgaatcttgtttccaaatatatcaacatccagtcagttaacatgttgtgccaatccatccaatgaaaattttatcctagttacttcttacattccattaacatcactgtcaactaaagaagaatgttagaaaaaataatcaatcagcacttatggatctctagtacatggcaggcatactgctggatatttccatagaatatcttattagatcacaaaagaacccttgaaggtggatattatcatcctcaataaagccaagaggtggcagaggcagtatttgaatccaattatttcatctccaaagtcctgctgcttctgactttgggtgtgggggcaagagaaagccagaataaatagactctccacagtctcataaaattcagcattggggatcatgggaataactaaagtgaagacaggaacagcaaagaattctagtcttggctagcttcacagattcagccttgagagcatcctttccaatgaaacctttttccccccctttctagtgaattaaccactaacgactttctgttacgctaggcactatgtgactttatttcaagtatttgttttacctctactactcctaagttcagataacttatttaagtcagctacttccccccagcatctagcatataattggcatataaggggaatctagtatatgttttttggtcaaaaaatgtagtatttgtccattccatttatttagcattcatattattctgtcttagttatttttcttgtagatcttattttcacaattagtcagttcatcatgtggagaaaaagtatttctacactgacaaacatactgactagggaagaatgggcacatagtgaatttcttttgatcaatttaaatatctgattttcctactgctatggttagataattttcagtttgaatatgctagtagaattcagtcagggtaaaatacagatctgatcttctccctcaccctattcaggataaacttaggctccccaagttgaatggaaacgatggatgtcaataatagcctatagcaactccttttgtgttatttgtattctattggaagtttcatttccacttcctaaactgaccaacaaaccaattcagaattaaaatagtccaagcacttcaccttgatctgcttatgtctctgaaataattctatctatttaagacgctgaactccttgaacattggatttcattttacctggaagagatctcctccaggaggtcagtgtccttgaagtaaatatatgggaattgttttcaaattctctgttggattcccaaatgctgtactttgatttgcttatttatattcaatgataccatctctttaagactgcaaactgcttgaaggaatagatcatcctttaatctggtttggaccataatcattataattctatgcacatttgggtgcttaatatttcttgataattatgagatagtgaaaaaatagcgtattgaaatattttttgtatacttctcagcaaacaaaattttttaaatgctcaattatgtcatcaaatgatataaacaattactgaaaggggttaagaaaaatgtttcatataaaattcccatttgctgcatttaacggaaaaataaaaacaaataggaaaccagtagtaaattatactacttgtgaaaacaatattattaaaatataagtgaacactgaaaaatattttaattaacaaaataaatcaaatggaaaagattccctaaatagagctttaaaagtaagtctatgtgtgtctgactgccatgactaattatgtatccatgtaatgtgtgttcaatttgggcttatttaaatagcagaaatgctcattagctgcagtatatctgtgaagcttcagtaaacagtttaatggtttttatgtttaaccaatttcataagttcctgtaattttagctttagcagctcattaatgttattttttgatatccatcttacggcttttttttttccttgtcaatcgtcagtaggcacacttcaatgcaaacttaaaacacacagtagaattttgtttaaacaattttagtacataagtaaatgtgcaattcaaaagtatagtttctttatatagagaactagctgtattatcatgcactcaaaaaatatcaacattggcaaaggctatatctaatggggataaaactataataatggaaaacatttattgagcgctttcatcagcatgtagctggctctaggctaggcactgtatatactatctctttggatcctcacaaaataggtataactcaattttatagttgaggaatgtgagattgagataagttaccaaggtcacacccttaggatttaaacctcactagaaattaactacatatgtagttggaaaatgcctgaaaaatccacagaagcatttggagatacacacctagacctcagatgaaggcactgcaacttgggatcaaataaatcacaaggctgggtaaagtttccaaagaaagagtgcaaaaacaggtgacaatagaatcatccacttatttttaaagtgtcagcaagcataacctgaactaaagctagagaataattcctcagagttacgtgagaatcaaaatatttctaagccacaaaagccaagtaaagaggtaaattcaacaagtattaaatacaaaagaaatataatgtaggtaaatagattgatgacgtggaggtcaatgaaccgtaaaaaggtgacacttgcagttaaatagtaaaggcaaaaaacagaattctgaagttatggacaaagtatctggcaaagacataagacagtgtacacaagctattcttcccaggtgtttcataatttttaataggaaaaaaagcaaggcattaccttgccttcattcattcaattagcaaaaaaaaaaaaaaaaaattgtttttggtctctcatgtattacatcctgctgcaggcaccgtagtaaaccacagataagagacccatccttgtgtgttgtaaatttcatctggcagaagataaaaaatgaaaagtaaataagtaagtgaactatatgatagtgaaaatggttatgaatagggttacatgaaagagactagtacaagatgagggatgtgagaagcagaaggggtgctttagatcatagcaattatggagggtcagagagcgcctctttgatgagatgccatcagagctaaaacataaaggataagaatgaaccagtcacgtgatgacttagaggcagattattccaagaagcgggaacagtggcaagggtgttaaggatgagatgcagttatagcacgtgaggagtagaaggaaggttttatgtgggtgaaggaaagcaagtgagacaagagaggaagtctgagaaataggcaggggccaaaccaaggagtgtgttagaaactgtagtaagaagtttgttacaataaaataggacagcatttgtagatttagaacaacaacaaaaaagaaattaaataatctctgtttagaagctcattctggtaggattatatggaagtgagagtagaagcaggatgaccagtcttaggaaaccattctcaatgcaaagagaaagcatccagcgtctgaccattccctgaacagaaggagggctggctggccttcatgacacctcacaaatacaacactttcacatgattttgcccttactgttaattttcagtacagacatttagaataagtcacttcattcttttcattcaaccatttattcatctcttcactcattcatccatttggtgaatatttattgagttaaggactgtgctggatctttgggttaaaatataaataaagtaccctgcagtggtactgtcaatatacttcagaatatgtaagatatacagagtgaaatagaagagcaagaatcaaaaaggagaagcatatttaactacatggtccctatatgtgtgtagcaaacatatttaatctacgtgcctctttagatttccagtaccacaattctggaataaaattcacatagttaaacactaaaaacatttcatgaattagcaatgatatgtttttccacccttactctattatttcgcatataccttataatctagacgaagaaactcccccatgtattcatccagcctgtttactataactggaatgggctttcaatccctgtctctgttctcctaattcctacccaatcctcaactattataaatgtcactgcctccacaaaaccttttaattcttgctgctgcaagtcatctctctaccctgtatgttacaccagaaatttatctgtttctcctgagtcactttctacctaaaggtaactttatttgcatgcatctttcctcctttattagactgcaagctcctgcagatggggacaatgtattcatttttgtgaactttagagaacctaaaagaatcttgtataattaatacaaaacacatataataaatacagaatgaaagaatgggaagtaacatcccacaagtatgtaggagggcagattagtaggatgtcaaaattaaattgaagcatttggttttaatcccaccatcagggaagaatagttttagattccaaagtatgagagtaatgtgatgagactggtgatgtaaagttcatttggcatcagtatgcaaatacagggagaaacactgggtcatgttaaaccaaatgaattgtaaatacactttgaggagggcttggaaaatcactggatatttggcaaacacttactatgcaacatgcttgccattctttcacatacttgtatggaaaaaatggtcaggtaagtcttgaaaacactttaaagagctttagaattacaaaatataacaagtatggttgttaaagaggaaaaaaagattagcactggttagcattaatccacatactgttaggcaggatccccaaatggatgttaacattaatactggtttcctcctccaacaatggcagtatattacatttgaattgagtagcttccatattttgggagtagatattgaataagatttaatgtaattttctaatttatacaatagcatatatgcagatcaatgtcttatttttttgagatggagtctcactctgttgcccaggccagagtgcagtggcatgatcttggctcgctgcaacctctgcctcctgggttcaagtgattctcctgcctcagcccccccgagtagctgggattacaggtgtgcgccattacacctggctaatttttgttttttcagtagagacagggtttcaccatgttggccagctggtctcaaactcctgacctcaagtgatccacctgcctcagccgcccaaagtgctgggattacaggcgtgagccaccatgcccggccaaatatctaatttaaccagagtattttagatagggatgttgtcctatttatattgtgctttgagtcaagaacagaaacacaaagtaattaacaataataatctcactctgcaatacaaaatacatataattaagaaccttactatactctatattatcattttatagtttaattaaatcttacatcttgattttacatctcacagcggcttagttttagtttaacatttcaccagcatgttaggtttcagaataaccttttactatactataagctaactagtttttaaaataaaaatattataggctgtggtcaataaagctcagtttatctattacactcaccgtatctattacattaaatacatctattacactcactgtgtgttcaaaaccattggctatgttttatgatttctgttctctgaaacaattacgttattttttcccattttctaccttctttccctaacaaaacttgttacatgccactgctctacttcttgtatgtaatcttcaatttgatggaaaactactgatttatccactgtctccctgtaagaatgcatatgatatcaaccagtagtgaaacctggaaaataaagataaggaaaggctctgagcagagctattcactggggaaacaaacctattcctatgcagttattagagggaagtaaaataattacagaaatatcatgttgtgcttcaaatggatatctaaggcagatgtaagtgatgtggtgttgattcccaatcactttcaacactgttatcagtttgacctccatcctcatcacctccaccctttcaaaataattccaaagaaaacctgtgcaaggattccattagtttggatagttattctgcagaaatgccagtacttacactagattccaccacttcatcctcaccctgcacaacatatttcgtaatagaaagatgataaatctttcaaccaagcaaaaatacttctgataatcagaacaatttttgaaacatgtacagtgtttcagttaggttcctgaaaattcttcttgcccaaaatataattaaaggcaaagcactgtacaaagaaggcaaaaatagttcattttcatcatttcgcaatcggtacacaggatctatcaatgttattattcaggcattttaaaacaacatggcagcacatgaggaatcatgtgtgttattaaaaagcgaacaggtggtagagagagtaccatggaataaaactgtcccttcatgtcataacctccttaaaatatttaccatcaggaaatcaacagtaacaaaagctgaccttttttctcttcatattatggaatatgacaggcttctggatttccagaatcaatgccacatatactctttaatcacactcttaagaagctgttatttaaatgataggctacaacacctttcattaattaattaaatcaatgaacagctcctgctgtaggcattaaggtatagtagtgaaaagacaggaagatgatgtgtactaattcccaatgtctgttttcagtcattctctgtttccttagttctagtcccctgcttcagttgttcaatagcaaatccaaattcaacacaccaccatttcactcagatctcttctatctgtgagttctgtcagcactataaacacctgtttacctcccagctagctaccccacatccaatctctttatcaagcagataaccaaatcctgactattctacttaagaaatatatcttgattccaaattttctcctgtatttccacttcctctaacttagtcacggtaactactgaaaaaattattttaatcctttaacttgtctttcttaattccaggccatctttcccaaaattactgacactgtagttccacactcctgatgttgccttccatgtaaagaaacaatcatttgtataacagtcagggtgtcgcattgtacctttctcgcctctctccaaaacactaaaatagaatccaaattagtgaatctggaagaagaaataaggcatatataatccaccctggtcaaacctataacttgagagctgcccatctgagcataggttctcagtcgcccctgatactgaaaatgttactgggtcagcttctcataacggcatttactgtgtgggatcataccctgtgactgaataaccacctaattcaggtcaccaaatgttagaaaatgcatttgcctactaacatgaaccatctcaaaatgtggttgcttattttctaacccccaactatttgaagattattacaaatggtgcacaatccaagcagagagaaggaagctctaacacctgctagaattacctcattcaagacaaagagctcttccttatttaaacctcctcatttgtcacctgcatgtctacagcataaaattcaaaatccctactttagcatataatcctttgactccacatatattttagccatatttcctgccatcttatccctacctgctccctacccttatgtaaccacacaccatctggtccagcaaaacagaatgcctccccgttgtctgggcatatgaggtcattttgtcggcccatacttttgtatatgatgttctctgtaacaggaaaactcctactcaagctctaaaacccattccaaatgtgatctcaaattagcacactgtgttgctatatatgtatttacatgtctatttctctcattagcctataggtccctgaagggcaatgactcttttacttgtgtctgtattcctagtgcctgagtagtgcctggaacacagttgtgcatcaagaaatgttcattgcatggtgaataatgagagaatgaatagtagaaatcataaaataaaaagttctatttagaaatacaaatgaaaaattcagaccatcatttacgaagatgagaacatgcatgaagtaagtaggctgatgacaactttctaaagacatatattttttacagctttttaaaatgactgtaaaatgactatttaatctaacagtgcggtgttgagcaaattgcataatctccctgtggcttccctcccttccacccccgttccacctggaaactcctacacatcactcagacttcaatttacaacccacttcctctaggaagcttccctgaatgcttagactctgttctgtgcttcctcgggaatctaaacttctcaaagtacaatttattgtaattctgagcctcccctgttaaaatgtgcattcttggaggcaaagtttgcatttctcttttcactactttatccctgaaacgtatctttaaaaagagtctgcactagccaccatacgttatttaaaaacctgtgaagtgaggggattagaatatatgatctctaaggtccttctagcacattcagaaatataaataaggaaaatcctaatgcaagttattgtattgtatccagtgtattataccggactgattactttagttcttaatgttaggtaagaatgtcattcattcttacttatattaatccttaataagtcccttcctctaatgttttgccattagtcaaaaaggtatcctaattagcaatataatgcagtattctttaatctgttctttgaaacttcattgtaaatatttgtttattaaaatgcatgcaacagtgaaaatttgatgaattatgatagtttctcaaattagtattcaatttttcccccttcccctttatttttgatatgagaaattacgtaagctgaaggtcataaagagtggttagttgttcaaagaaaattttgccaccagtagcttctataagatatgttttgttgtttgaaaaatagaacatgatgttaaccaaaaactgtggtttattaaaatgttctagcattctcaatttcattataaattaccaaataagttacattttaataaggagtaaatcaaatcaaacatactgattccaggtcttttaaaacatagctaactaccatttttgaatacctaaataatataatgccaacattaaaacatttttcataggctcttcccaacacttaaacaattgagaaaagaaaaatggacacatttgaaaaattcttgaatttttgcatcgtaagaatcttagcaggccatttcttgcctaactggcaatttctagttctgagttaggccagaacaaggcaaattaacccatggcctgcaccttttctcagtatgggggcaagtgaatcaaagctacactcaaagctgctattgacagaatgtttgatttaccccatgaggctttcaaaaacttttctgagggccttctaataagaggaactgatgagtgatttaaaaacctttttttttttcctgcaaacactcccttatggaactaactgcaatcaatgttatcaagggagctgatttctgagagttgcatttaagattcagaactatctaggttttgtgtttccttgttatctctagttcccagtgagtgagcagaaagaaaatgtaagcagtgggtgaagtacgtaaattcctttcctaacagaagggtcgtatcttccctggctgtgccctgagctcagtcaccttgtctccgctctactgagcagtgtggtgcaacatgatgctgagtccctcaccattcatcctaacatcttccttcccaaaacatgggtttttaatcttagttatgtaatcccataattttcaagcatttaaaatctcaaacttagttgaaaattcaaaagtgcctttcttgtcttaaaatacaaatgaatgatccttacactaaacaaaaaaatgtggtccaattttcaccatttctaagaggaagaacaaaagtcatttaaaaatatgtgctttttacatacctcatttgcagaaattcaaaatggagatttcttttttttttattatactttaagttttagggtacatatgcacaacgtgtaggtttgttacgtatgtatacacgtgccatgttggtgcgctgcatctggatcaagaaaatttggcaaaatggagatttctaacaactaaaaatagttgaaaaattgttttcgatggcatgaaaaacattagaattgataatagtttaaaaatatataatacagttacagactgttcaatctttttttcaggaaaaaaactaaccaaatatattgaacaatttctcattaaaaaaatcatgaatgtatgagcatctgcttcacttatttacaaagtcatgttgacagagcctccaaagttcctgatgaagtattgatattcaaatgactttattcccaaacaacatgaatagctacataaaagttaatataaatcaatttaattactaaaatatggttttgttacagattaataataacatctgtaacttaagcttactatatgctacgcctatatgtaaatgatttacatatattattaattcatttcttctaaataactctaggatattcatactatagtcatcccccttacagcatgaggaccatgaagaacaggtagactaagtaactcattaagacgatgaagttagaaggaggacagccaggtttccagctggggcagcctggctccagagaccccactctcagccaatataccagatagactctaattagtgtaatatttattgtattatgaagaatacaacaatttatgccacaacaaaggaaaaattcagagcaatagaataatagaattatttttctaacttttacattttcgaagaaaaataaaccaagcagatcccatcataggagaaaatagtaactcataagaaaattaataccctaacatgaagcaagtcaagtcaaatgcacaaatatttttgtggatctattatgggcacactaatatgtcagttgctattgggactacaatttagtataaaggtgcactccttgctctccttggggtttataggataatttgaaaataaaatagattccggaagatcacagaacataaatctttacagagtcaaaatttcatataatgaaagagtggttgtggtacagggtatggaggaggcacagaatcacagaatgagctaaagtacattcattcagttgtctgaaagcatattcaacaaatcataaaattatgtcatccagatctcctaggaatgtgaggacacaggcaaccttattgccttggttgtaaaaatgaagcagtgagattagtgaaagggtggaagaattcttactaatgcaaaactaacagaaatttgggcccacttaacaactgccagtttggttccaacaagaaagagaaggagagatacactataaaacaaacaataaatcgattaaacctgacactgtaccaacaaacaagaagaaacacaattcaattcaataaatattgaaaatagtgtttagcagaagaggaaacatcctatattaggaaatatatatatttatatcatatatagaaatatatattcatatatttatattatatttatattatacatatatgtataataaaatatacatatacatattttaaataaacgtttagaactttccagtgaatggacaatatttgtaaagcagaaatgcagttacagaaagtttgtgcttaatctcctgatagcctttacagtctatctagaacaacaaaatcccaagttaatgtgacgtgatatggagtcgtacattcttagagggaatagaggagactttttaaaagtagaaccattttgagtttttcacaagaaagatatttaaggctgacgttatatcaattgagtcagaaattggacaccattgcctttaaaatttgagctagtgtttaatgaagtattcaattaaattatgctgatcggcacataacatattccatgcacatggatatggaatatgtagtcttttgttcctacttcccactccctggtacaatccaaaaagtgatggaagaaacagaattatgtaaagtaatgatgattacttatcactcttattatccttagtggcaacgaaataattagcaactataatcccaaactcttatccaagtttattttataaatgatatacttatcttttctataagctgttgaggcacttatcattttatgatagggaatatttattacagatatattaggtgtataacactaaaaaagttattttacattctccattgtgaaacaaatttagaaacttacaaagattgtggaatatttcagaaaaaactgacattaaaaatgtaatctcctttcaattttccaattagcttagcttttcaagttcttattattgatatatttgagattttaaaagtattttcatttacaatattattgcaaccagagacttctgagagtgtaatttatcactgtactttatatgtactctgtcaagtttacttcattacttgaatttttcagtatgtctttatgtaatgcatttaccaaagattttctgtgttgccactatggaatgttccctgtgctggatgctggcaggaataattcaacagggaacagaagaaaatataggtggatacacagaatgtatataaggccatttgctgatgttctcaagtgttgagaagtggaagctttataccatagtataagataacattggtacatttaataaatattataattagaaatttgaactggggtaaaattttgaactttggctatggggagtactaatggtaccatttgcaataatagtgaatttgagaaaagatctgttttaggtaaatctgataaggtgaacttttttttttttactttgtgcaaatctctcttaatgtacacattcctcactttgtaataaaattaattgattacagatctgcctccaccctagtctatggaattttaaagcccatgcaatgactcgctcattttcatactctctagaatataatttggcacctggcattcattaggtactcagtaaatgtttgtcacatgcctgagcaaaaatttaggatgaaaggaggtcttctgcgaaatggggagtggaaaactagatttaagagtcatttttacacaaaaaggaaatagtgcctactgtaagtctagccactgtctggcacagagaagttcatttatatgtcttgaggaatgaatgcacgtatgaatggataaatgaaagaatgaacaagacattcatttcactgaagaaataaatacgataaggagagaaaatgaacaaattctgaactttggaaagtaaaaagctagaggaagaaaagcagtcagtgataggcttggaaaggaatagttaaaagaagcagcaaggtaatagagtgtcacaaacaagaatatgctctagttttgtttccaagtcttttacattatttcattttaattctgacaatagtcctgagaggtagaaagataatgtattactacgcttttttttagtagataaagaaattgagcctcagaaagtttaagtgacttggaggagagcattttaaacagaattcttaacattatcaatcataaaatgcagaaaatatactaaggactgaaaggatgtcactgcatttggcatgcagttcactgaagtctgggcaaagtgaggttgaaaaggagaaaagtggaggggtggaaagagaagtaaacattttaaaagatgaatgcattaaaacaggtatcacatatgtgataatcactaggtaccatccagaaatgacatgacatagtgttaggatggggaagaatttatggtagaagaggattaacatgaatatcttctcttcttacccaaatggacatcttgcttccaataaaatgcttttcattttattttacatatatgtgtgcacatgacagttttctgactttgaaactattaagattttaaatcctattgagtaagatcttcttgatcaaattctaacaaacactgcttctgtgactcctttatttaatgttttccatccaaaagaacagtactgaaaacatttagatgggagtccaggaatgaatgctatctcacactgcagctctgccagctcccctctcacttggagaataacttcttattaaagtaaacatggaaggctcctggtaaagttagtaattctacttaaggataatttctacaggcagtttattatttcaaaccagaagaggaaaaaaaaatagcgaagaaacatttttttccttgacttctctaaatttataagaggtggcatatgtgaagtactagaagaaatatacacagtaaattctggaataaaatgcataaattctgaaatgacctagtcaaacttgaatagatcaaattttctccttcttcatattttatatgctaacttaaatcttttattcttcatacatacatacacaaatacacatgcctgcgcgcacacacacacaagcacaagcttataaaatcgtatctgagattgcaaaagctgttttctgagccaaatctgttcaggtttgtttaggaaaatataattattattaatattaggattgtcaattatggaacacaaatttaaatagttaagctaacctttttggataggcaaataatcaacagaattgctagttaaacatgattcaacattttactcaatttttggtgatgtacatagtatttaatagtaagaagaatgggatttttaagataatataagcactttatatatcattcttttttccttcctgaattcagttaaataaataaactatactctgactgtgtctacataccacataaatgtctagataaaaagtgacaaatttaggccatcatccagctatttgaaaacatttatctcgatgacattaaacatctggatgtttccacataccaagatgtttgatgccctgcagataaaatatctgatgactagttgaatcctttacttatctgtggcataaaaatatacattttcatgtatatatctcttccaacttcagacaaaaaatgtaattttagcatggatatagtaggaagtcataggaatcatcaggtttagagagatttttggtatggttgttcttaatgaatctctgacctagaaaaacatattttattttcccttcagaaaacaaaagagttaattgtcatttcaataatgtgaattaaaaggtaaaaggatttgtaaaatgaaagtacctagatacataagctttcatctacaatgacccacagaaacactgtatgtgggaaaagtataacataaagtagtcttacttgactgaatcattattcagttgaaatgttatataaaacatttctttctctcattatctttttaaaaaacattttgtttttcttagcatgctcatttatgccatccaggtgaaaatgacagacatttaaactttctaatttgataattctgacatctgaagtgatgatctggcacaaggatggtaataaacacaaattctatttttggccattcattagattttgatttgtctgaatcattgaagactggctgttccaactactctgcctcattttcttactctagtctaattgaagaaaaagccattcttctataagaaacaaggcaaatatcattatagagtagaatatgtgttttggttataagcttaaaagaaagattaatgttcttttcaatacttgccactttaaaaataattctatataagcattaaataacatttctaagccttttgaatcaagattgcttttacttcttaactagaagaggaaaataaattttaaagtgaaaaacaattccctgaaagctagaaactattacagcactaaaataacagacaattgcatcacacatttcagctcccagcactgtacctttaggatcactcagaactgaaccaaaggcactgatgaccacatcggctttcagatggaccatctgatcttcatcttcattccattttccagtttcatcttgctctgtccgaacaaactgcatagcaacaattctcccaccttttactataaccttccgtggggacaggaatggcagaaattcacacttttcttccttagcaagttccatctaaaacaaaacagaacagagaagaaacttgaaaatgtttcttattccacacagtatttgatttctaattgaattacacatgctaaagcttatgatattaagtcaatatgcagctttttctttcaccaaacctgagtttcagttaccagttatttgcattttgtaaatcactgactcagggagtcttgaattggagttgtaatgtggacgtttatagatcacggcatcataaggtatttctcaagttttaagtactgcatgctctacatttggtagtttgtgaggtttctgaccatagtagcctattatttttatgttttcaattcagtagattaaggtctctttttttaatcatgctgcatattaaaataaatacttctgtttattaccaggttgcatacatccaagctggaaaaaagtcaataaagtgggtgagccaatctgtgcaagtacatgattagaatggtaggtaggagaaaaagactagagaaactctgtagaactaagaaataaaaaacattttttcttccctttataaaaccacagaagcaaatactataaatgaaaaactgaggacagcgaaacaagcatgtcctcctgatgaatgcccagttcttccccatttcctacgtaattcattttgccataaaatctggatacctcggtttctgtttgttttcatatgcataatggaatgttcattgagacagaatattaatgtttactcatttgcttatttttccattaattgtttttggagaaatccaggcctttgtcaatgcaatcagaagtactatgttgaatgttctttttttaaaaaatgcaaaaatgtcctactgaagtgttttgggatgttgtcttattattttccttcactctgaaagccaggtagattctcaataggctccctgggtaatgtttccactgaggttgtgtgtatgaggcttcaaactaagagttatctgagctttgtcaagatggaaaaactgagacataaaataattaactcaatgctgtaatcaagccatgggcccatctttcaacaacctatccagagctagtgccatgcatcacaatcacctggaaggctaattaaaccagactgcgcaggcccattttcagagtttctaactttggagggttaagtggggactgaggatttgcatgtctaacaaatgcctaaggtgatgctatgcttctagtgcacagatgatactttgttaaccactgtctttattagattatagctgactggctcagcacttgttctctatgatgcattttcaaagacaggaatattgcccctagggagcaaaaattaattcttgggggaaagaaaaaaatcctcagatatcataatggtcttgtcccttcaagaagagctaaagtatgtaaacagttatacagtatatctatggtattaaaatcatagcagggaggattaagaaaaaaatctaaagatactcccaaaaagggtaagaagaaaatggttgggaaacactgatctatactatacattattttgaagctattcaatctatgtcttatttaggatatttttaatattgtcattaaaggcttaaaaattggaaccacataaaaattattacacagtctttccctttttattatgaaaatcaagaaattagcaatataaaacaaaacatgtgggatgttatgctggtaaacatacaaaacagttgatataaaactgctcactcctcagacaggaagattagaggtaagcggaattgaatcaaatttgaaaactgctctgctgcttatttgggatagtttccttatatataaaatggggagaacaccatctcattaatcggtatgtgtggtgttacttaaaacaactccaaaatgtaaaatgcctaaagcagaatttagcatatagaaggctatgtactcatagttgctattttctgaattcactttttttttctctgaatcattcttcagctattcaatatcacttagaaataagattgtgatttcaagagaaaggtggcccaataacaaaggttagtaaaaggcagcacaaagacaaaccttagactcctctttagttttctacaaaataaaaatgtatgatttctggaaggcaaattattccttgaataattcaaattacaaaataaatatgattccaatatgtaaaatatgttttctgtatcgcttttgtcatatttgtgccacatatcaccttataactcatcaatataaaccagtttattgtgtttcaaaatgtcaagtggtgctacattttaatgataatgccacacttgactgaataacaactccaaatgtttatggtttgaataaatcaatatacaatgtgtacctgtaacagtactgttttctgtggagggcagaaatgaaacactgaactatgctgtacctattgggaatatgtcttacagatcgatttaggatctgtttgatcccactctatctttgctatctattaatacctctacagtatctgttattacatatagataatctcttatatattttggcaaatttggcattaaatttggaaacaaaaaattggacatgactaaatcaaaaacttctatgaatttaaaataaagattattaatcactgaatgcctaagcatgttttagtaatgtttagtaatgttctcaccatggttttgatttttgaggaccttgtataaccatatatagttacaaacataaaaaaactggctttagcatatgctcatctatgtgccccaggtttgattacatgtattcaaatatctggcattcttaccaattatccgacagtgcactggggatggcatgagcactggaccccacagagattcatctgcatttttgcttttgaaactttggagattttcttcactcactagtacatgtagaactagactattaagcagcagacataaatcacaccacttctgctatttagctcgatagctagattttccattttacataagaaagggaaaattgtttaaagaaaaaatagtaatatcatttgcatatatatatttgtttggaaagtattaatattgggagagtgagatcatgttaagatttatcttgggaaatagggaaatactaggacaatgaaaacacagggtaaacttgtatagtgaatgcttatcattttatgctgccttggcatctattttaaatataagctggactttgttatagcagaagaaagattcagtcacccttgacacacatagtttccaattctatactctacctccctgcagcacccccgtttctcagtgtggtggatcaagatatttcccttatacacctgctccctgatcaccacatccctatgaaacgagtagatgcagcctgctggactggtcctgctgaccctccaccctgcatggactgtgcagacacaccacagtgactgcctctcagtcaatgcttgacgtcctggaacttgtgcctgcttgctttaaaccaaccagttaaaatttcccacgagaaacctgtttggataacgccctggacccataaataaaggcactggcccgcaggtcccattttctctctttctctttctctctctccatgcactcctaacctccgtgtgtgtggcctctgtgcattatgtgtaccccttcaggaactgtaagtaataaaatctttatttccatcttgagcctgtcccaatcattgaaggaatgctctcatcttaaagatcctaaattaaaattgacattacatgtgaagtgaaatatactttgaaatatttttggacattataaggatttactttcactatttaacaaatctattatttgtcttgttataagtattgtcttattatttttgttattttttattttattttaattaattaattaattaatttgagacggagtttcgctctgttgccagttgcccaggctggagggtagtggcaagatctcagctcactgcagtctccgcctccccagttcaagtgattctcctgcctcagccttccaagtagctgaaattacaggcacccgccaccatgcctggctaatttttgtatttttagtagagacggggtttcactctgttggccaggttggtctcaaactcctgacctcaagtgttccgcccacctcagcctcccaaagtactgggaatacaggcgtaagacaccacgcccagccataaatcttgttttataagaagataaataataatggtaataagtatttataacacttaaaagtattcttttaagtgctttacaggtaattcacttaatcttcacacagaaaatacatataatgctttacctgtaactcaatcttcagacagaaaatgttatgacacccatatatttgttacaaaaaaaaagtatttagcttcaaaccgactttgtctccgtgctgtggtgcaaaaagccaaaaccgcactgggcatcatcatgattttacagatttagcatacagccttaggcacactgctgcttgctggcctcacaaagaaaaaaaaaatctgtggacaagcattattttcttcctacagaggagaaactgaggctcagagaagccaaaaatacactaagggatgaaaaaacttatctgaaattaggatctggctgaaacgaaatcctatgtgatcttcattatgtccaagaataacaactgtagtatatttgaaataatgagactgtatgattctagttgctgaacctcaaacaaagcaaagtggaaaaggaaaagctaaagtgaaaggtgaagggcttggctagacatagttccctttgtgggaagaggagactcaagcttcccagtctaagctcatttacaggtactataaaatcatgaaatataggaaccacatgatggatttatgaacccaatactgtaaacgagttaatagagacaccttgaatccagataaagagtaaatttagaacaaaaaaaagtactacttcacaaagtggatattagatacacagaacatattatcttaagatacaaaatttaaaaactaacagaatttaaataagtttgttcgatagtaaactcgttctcaacactctttagaggaagaataccttatttaacattctatcctttatgtccaagagtgatattaaaatagtcaacaattgataagtataagcccatgaacattaagatagacacccagcaaatcagaatatatgccagtcaataagccaacgaagaggcatcaagtgaatgtcacatggaaggacagggcatcaagactggtcacagccctacctgtgtctatcaaaatgattggcacacagtagaccttgaatacagttttgtttagtagaatgaaggacaaattattatgaaaatctgaagaacattcaaattaaggaaagtacaaccaactagtagtatactgagtgaatggctattaaacatccatcccaatgtaagtaacaggacacagcagaagacatgctacctgcccagatcatcctatgttgcgaggttgaaataaaaaagcaaatggtgttcctcatcagttgtcaagttatgctgctatcagaaaacatggaccaaattgacctgtggtctaaccacatgcagcgttactgtttaaattaaccagccttctgtgacaagtaattcacacatgtcagtgttagtgccttttaacaactaatgtttgtcaataatcattaataatcagtaactctgaatctggatatgaatgcttctcctcatggcacccatatatatttatttgtttgatggagcatgtctttatgagggacaactggtttatcaagcaaacatgccaacctctcttttcctagtctccaccaataaagtagtaagcagctataagggtccattttttacatttgacaaatcaggttgtcactttctttttacacagtagtgggaaagttaaaaaaaattctcagctttgattttcacctccatattcaggaaagatatgtggctgatgctgagtgaaataaaaatagcatgctataaacttgcaataatgatcatcattttaatgattaactttatgtaatgcgatgatttggtctgattaatattacaggcatcatactctagaaattatgaaacaacttaattttctataattaaaagcatgatgtcaactcacttttagattgcacataggcaaagcaagaataggttataaagtataatgagcagagctcaaaaccagcatatattaaattctggaataacttctaataagccaaagtttgagaagcaatatgaagaaacaacattctttataaaggttaccctctaatactaattgaccatttatccattctatatgaacacaaaaacctaaaaatattatttagaagcaaaattgtttagaagtccactttggccagtgataaacctagaaaatattatctcatttcatcactgttaaattattggatgtaccagaaacattcagagccatgtggtaagagcacgctctatgcataaatctaaccaaacatttgttaaatattatgtacaaaaatagtgctgtgagctacagttaaaataaactctgccttaaaaatctcatagaagcagaaaatcagcatttgtaggtaataatgtatgacaaacattatttgcttgacccaactttagtcaggtttctgaaccttttcctaagcccacttgtgtgcttttttgtaaaatccagatttagcaataaccctgctaagtcagtttagcaaaatccctcacccttgatatctaatcatcttcaatatctcatcaggtacctcatcctccactatgacccaggtgatgtcttaccctcgcctgtcttctgcaagaatcctgttagattgatttagccaacaggattaagccttaccttgatgtttcctttcagtaatattttatctactaacccgcaacctactccttggctattacttcctacctccgcattctgtatttggagtttaactcgcatttgggggataaaaagtgtcatcagatattgataatggagggttcttgctaaaactgcactttatggggaagtacacaggtgggccttggagaaggtttaggagcctgattaaaatttggcctttgggaggccaaggcaggcagatcacgaggtctggagatccagaccatcctggctagcacggtgaaaccctgtctctattaaaaatgcaacaacaacaacaacaacaacaacaaaaattagctggggtggtggcgggcgcctgtagtcccagctactcaggatgctgaggcaggagaatggcatgaacccgggaagtggaggttgcagtgagctgagatcgcaccactgcactccagcctgggcgacagagcgagactcagtctcaaaaaaaaaaaaaaaaaaaaaaaaaaaaattggccaagttaggaatctttgtcatgtgtaaaggcagtgtacttgaatggcacataaatgggcatttcacctagcagtagtgcagatcaaggaagggcagcattgctgggcatggtagctcaggcctataatctcagtgctttggaaggttgaggtgggagaactgtttaaggctatgagttgaagactagcctgggtaaaatagagaaacctcatctctactaaattttttttaaaaaatttgccaggtatggtggcatctgcctgtagtcccagctacttggaaggctgaggtgggaggatctgtagagcccagatgtttcagattgcaatgagctgtgatcacgccactgcattctggccttggtgacacagcaagatcctgtctcaaaaaaaaaaaaaaaaaaaaaagaaaggacagcatggaaaaggtgctatataagctaatcttgaaagaaaagtaggaattaatcactggaaaggaattagttactaggaagttcttgtatggaatccattctctctctttgaagaagtgggtgtggaagggtaaaggagtttatctcaagaagaaaagaaggaaagcagcttggttaaagctctatgtaatatgtaaacatcctactgggaaacaaactattgtcatttataagtggaagagtccttaccaatggaatgcttttggcatggcgtatctgttagtttaggattgctatagtaaacaaacctggaaacgtgaatttagggggcatagatcactataaagagtaatgcaagttacataactatctgagtataaattagatgtctcataagtgaaacaagttttttgacctaagtgatggagctacttacatgacttagagaccacatgttaatctggtttagagcaaatcctaatgcagcaagatagaacctgaggaaatctgtgggcagtggtcctgcacttcttgtttacctgagtttgtttttaattgtatccttgaagttaataataaagtttgatacagagtgatatttaattcatatgaatttgatttcacaatccaatcttctagttatcttggttaccaaggacatgaaggagggtaaaggaagaggcatcaaactcggcccattcacacttgatctcatattctttaatttactaaacagttttttaatatttagtaatttttgacttattttattttgagtggtgaaatgcagaacaatttttatatgttaattaatctctggcctgtacaagcaaattctgcaattattcttttaattaggcaaaaaaagtttgctgagaccacaaattgacattccttcttttagtacctggtatggtattacaggcttcattcacatatagaatgttttcattttaagttttttaaagttgaagaatcttgaacataaagaaacatttaaccaaatgagagttgtactacacattggataaatatagtcgtcccttaactgagtccttactaattttattgtgtcactattgtgctgcaaaacccagatatgcaatgtaaggaataatttagaggcttaaaatggcttgacacaactatcattaaatacatctcttttaacaagtaaagggttgattttttgttgttgttgtttgttttttgagatggagtctgactctgtcgcccaggctggagtgcaggggtgtgatctccactcattgcgagctctgcctcccgggttcacgccattctcctgtctcagcctcccgagtagctgggactacaggcgcccgccaccacaccccgctaatttttttgtatttttagtagagacggggtttcactgtgttagccaggatggtctcgagctcctgacctcgtgatccacccgccccggcttcccaaagtgctgggattacaggcgtgaaccactgcgcctgaccaaaaagagtatttttaaacactattcatttactattgatgacattttctttttttattattattatactttaagatttagggtacatgtgcacaatgtgcaggttagttacatatgatgacgttttcttaaacctaacacctattttcttcatcttaggttttgatggattcaagcctccctggcagctgttggagtatctcacaaaactacgttctgtgtaacttggtgcctttgtagttcctcctttaatcttaaaatgcctccatgtacaaattctttacaaattaggatcatctgttttctgccacctgctaatactctcggattctagtaatttttattattttttgcttttttatatattgcttgctcgtatttcctttttttttttttttttagttctcaggtatcttttaagagactgaaaactagggataatttacttttttcagtctacttttaatgttagattgacataaaaatgtgacgcaatattttttttaacagtttaaaataaaatgtgtacttattccagtctatcattgttggacatttgggttggttccaagtctttgctattgtgaatagtgccgcaataaacatacatgtgcatgtgtcttcatagcaccatgatttataatcctttgggtatatacccagtaataggatggctgggtcaaatggtatttctagttctagatccctgaggaatagccacactgactttccacaatggttgaactagtttacagtcccacgaacagtgtaaaagtgttcctatttctccacatcctctccagcacctgtggtttcctgacttttaatgatcgccattctaactggtgtgagatggtatctcattgtggttttgatttgcatttctctgatggccagtgatgatgagcattttttcatgtgttttttggccgcataaatgtcttcttttgagaagtgtctgttcatatcctttgcccactttttgacggggttgtttttttcttgtaaatttgtttgagttcattgtagattctggatattagccctttgtcagatgagtaggttgcaaaaattttctcccattctgtaggttgcctgttcactctgatggtggtttcttttgctttgcagaagctctttagtttaattagatcctatttgtcaattttggcttttgttgccattgtttttagtgttttagacatgaagtccttgcccatgcctatgtcctgaatggtattgcctaggtcttcttccagggtttttatggttttaggtctaacatgtaagtctttaatccatcttgaattaatttttgtggcacatatacaccatggaatactatgcagccataaaaaatgatgagttcatgtcctttgcagggacatggatgaagctggaaaccatcattctcagcaaactaccgcaacgacaaaaagccaaacactgcatgttctcattcataggtgggaattgaacaatgagaacacatggacacaggaaggggaacatcacacaccggggactgttgtggggtggggggaggggggagggatagcattaggtcatatacctaatgctaaatgacaagttaatgggtgcagcacaccaacatggcacatgtatacatatgtaacaaacctgcacgttgtgcacatgtaccctaaaacttaaagtataataataataataataataataaagaaataaaataaaatgtgtacttatttaaaagctatcagaaataattttgagttgtatgtacatacgtaaaattatatattttgaaaatttcatattaacttaaagtcttcctatgaagttttcaatgcttttaatatattggctaattcaacatgcctcactggtctgccaccttgaatcaagggctgcactatatgttgagtcagataccaagttgaattcatcaatccaataaagaagcttgtatttcagtttatggaataagtataaagtaataagtaccctatgtgataaattctattaacagcaggaagcataaaaagcccacagaaaagagaaattaaattggtagggaactaaggaagccttcaagagaaaatgacatttggagcagaccttgaaggatgagttcacgtgtagtagttaggggctcccctggtactaagatattaagtacacctctaagactttatgatgacagggggatgacacattccaaggatctgtatatgtttatctttttgaaagttgtgaaaattcagtatagtatgaaaaggtagaatggaattttagaatttagaattttagaaaaaaattttaaaattttttaaaaaatcacttttaaaacaatgacaattctttgtttttatgttaattcatgtgtatttttcatttatgtctttcgaatagcatatacattgactaatgtgtgtttaatagattatacaaattactttttaatattttcattttataggacaagaaaagatattgaaaagcggaggtgaatatttttaaatgaagaggggcttctaatgttcacctaaaaatgaatgaagtagagcatacagatctcttcccactttcaattattgccaggcagtggccaaagggaagttcaactcctttgtgacttctgacagcaagaaagaaccataaaaggtatttcaatgcaccttcccatgttcacagaacaattatgtcttccctctttccaaagagctgagatagaagtacaatgtttgatccatgcccatctgaaaggatgatgaagttcaggttgtgtgaggacactaaaaagttcagcaagttggcaaagtggtccaaggttacaggaagaattatgtcatttacattgaacgggtgcagcagaaaaagactgggctaataggacaactattcgtttgggcattgccccagcaaggtggttattaggttggaagtgaaaaaaacccacaaaagatccttgaatggaaagccaaatctcaccaagtgggaaaggaacaggacaaacataagatagaaacgatagagatggtgcaggaataaagtagtcttatatacaattttcattacaaactactaaaatgaaaaaaaaattaatagagtaataacaacttgttgttattaaataaggcctgacagtgacacaccaggtaaaaaacgttcacttttaatgaatctgtgggcttatctgtgaaaatacatacatacatatatatatatatatatatatatatatatatatatatatatatatatatatatgctgtgaaaaaaatatatatagaagattagtaaagatttcttaaaagcatataattttcagctcctcagatattcctggtcaacataatgcaacaacctccttcagaattttgaaaatagttatgcttttaaaatatgtaatcttaaatgggcacaagcttttgttggctcctggcctatttgcagtcttcttttttttccactcaccatctgaattatcacatgtactgtagaattctgacaatttcacctgtcagtttctttatactcatgtcttgaatatggtagattttacctcaccaattggctggggatacattaattgcaatttgttttaagtgtaatatttatacacatttctaaaattttcagtatagagctgtcactctgtgaagaaatagagccttcctgtccagattccacatcattcatatatatttctctgaatgttaaaaatataaaatgaggaatggaaaaaactttaagaagcatataattacaacactaattttatagatgggcatactcagactagaatgtaaatcaagaaccaagtgctccaactgtaattcctttttgactattccattctaccttttcatactacactgaagtttcacaactttccaaaagataaatatatacagatccttggaatgtgtcatccccctgtcatcataaagtcttaaaggtgtactttaatatcttagtaccaggggagcccctaactactgttaattagctttttgtgcctagagaagattttgtgtgagtgttcgttttcagctaccttcagagagcaaatcatgtcaacatgtctctgattaccttccatgaagaacaccaactcaaatgacgtgcaggtgccaaacgttgaagaactgctgtaagcatcacttttagtaaataaaattaaatttgtcagcttatgggggctattttctaaaaatagtcccaggttcatatttgttgtaattaaattaaaactagaaaacatcagttatctgtagaaaatacatgtttaggccacgcacggtggctcacaccggtaatccccgcactttgggaggccgaggagggcggatcacaaggtcaggagatggggaccctcctggctaacatggtgaaaccccgtttcgaacttaaaaatacaaaaaattagacgggcatggtggtgggcgcctgtagtcccagctactcaggaggctgcaggagaatggcgtgaacccgggaggcagagcctgcagtgagtcgagatcgcgccactgcactccagcctaggtgacagagcaagactccatctccaaaaaaaaaaaaaagaaaaaaaaaaaagcatgtttagccataagaaattgatgacaaaactatccatagacatagctttaacatggtcctttgacattaaaaatatctgagaagaggcctataggtcatgccacaaaaatgatctattatggggtatgctgtgtggtggtggaaaaaaatcaggtaaaaggcacattcttttaaatgttgtgctatttcaaagttgtagtaccagatgaagaaaaatttgatgaacagactgagcaatccggtattgttatttttctaattaaaataataaagtagcattaattatcaaaacagttaaccctctcaatagctaaaacatgtaaaaactgacataccaaagttaaatcagttaccattttgacaaacaaacaaagggaagctaaggcgtaccaggggtagcatgcaggccccataaaaatgcagcagaattaaagatcaatcgtgttttgctcctattggaaaattgaatatgtaaataacagatctttgaaatatactttgtgtgtgggattgtgctattaaaagtaaatttgaaaccatcctcttctcggtaataattaataagaaatataaagtccttctctaaccttatcctttaaatttatcaactctagcaggtctgttgagttctgaccttcatgcctccttttagggattcccaactgcctaaagcatccttgcagttctatctgatctgtcaacagcttttaataccagcattttgggggattctgttatcctgtgaaatttaatctcacctatttaagcttgcagaaagtactggagggaattattaacagattttccctcatcttcttagaggatagtgtcgagtgattggctggtttccctaaggacccatggctgagaagcgctagtttgtcagtagcatcctatttagcatgtgtgtgaggccacaagggagctggaaagacacttggaatcagaattacatcaatatgctgatgatgcctgcatatcttcatttcatcaaacctatatcctttagtattaatgctttcttagccaagatggaaagtacctccacacagcacactgtttgtgactctaattagacagctggaaagcatgttgatgatacatcagagcagtggaccagcaacctcagcatcacaaggaaacttgttaaaaatgcaaattctcagacccaccccagacttactgaatcagcaactctagggacagggcccagcaatctgtgtttaacaagccctctaggtgacttaatgcaccctaaagtttgaaaacctctacattagagaaatgggatgtgtttgtcactacagagtctattggatgatgtctcctacttttgtggattaaaacattcctgagtctaaccatatagttcttggttactaaccacataatatacatggtctcaaacaattccatgtgtatggttaagctttgtgcccccactcaattctcattttgaattgtaatccccataatccccacctgtcaagggagaatcatgggggtggttcccccatgctgttctcatgatggtgagtgagttctcacagatctgatgattgtataagtggctcttatctttttgctcagcacttctccttcctgccaccttgtgaagaaggtgccttgctttcctccatgatcgttaagtttcctgaggcctccccagtcatgctgaactgtgagtcaattaaacctcttgcctttataaattacccagtctcgggcagttcttcacagcagtatgaaaatggactaataaaccatgttaaatgtaactggcttctgtcataattcatatttgtcactaaaggataagtaaacttcatattgttctgtatttccctcactcagagaatgagaattagactgcaccatcagacatatacatgttgacatgcctaatggtgaggcattttactgacaaaccatgctatttccaaattacacccaagagtccatgaccattaaataacacacatatttgacgacatctctaaatgtccctgtccctcaatcttcactgactctaaagaaaccaaatgtggctgaagtttttactaggggagacagtgtaggagaaagaagacaattactcaagaaattagggccaatattaaattcttcatattggctaaaaattatgtgctagacctaacctttcaaaacctgtatcttaaagtagataatgatattggacctgtactctcctgactttccagtttcatgagtgttagcactgcaatattttggctcctcttttgatgtatacaaaaccaagcaatggccataaaggattaacactgaaacttctatgaatgccaaaagttcccagtccttacatggtattacccctggtaagagaatcaatcctgaaaactttgcataatctaatcatatattacttattattccatctctccaagaaattttgcctataattatgagatgaaccttcaaaggcctactgttataatatttatctaacttggaaggtattagcccgtgtaatgctagaaagccttcggtgctgattccctccagtaaatattcattccacaattattggttgaatcttttataggtagcacccaaggtgctaaacaggcggaaggtaaaagtgacccagagagatgatcatggccctttctctcatgaagctcaaggtcaattagttttaatatcatataaaaatttggttaattgtaagctaataataaaataattcaaacaatctaacatttgttcttctagttttaattaagaccagacccatttgagttctactaagctctactgcaggcaggttacctattatctcaaggatctgttgcttctcaacactttggtaatcaagtttcaggcagctgagctctggccttccaaggtgctatgcctctactctgatcctgtgcttcttgtaatctactcacattaaccaatagctcactcttttacttagcccctgactagcctctctgcttctgatgccactccactatagtcaattctcagcagagtagccattttaaaatttaaatcagagcttggcacttctctgttcaaagcagcccagtgatttttctctttcaatgagagtaaaagctaaaggtcttatgaatgcctacaatacataatccggtcagccacattctgtcctctcttactctattctgatgatactggcgttttttctattccacaaatccagaagacttccacaataaagggtgaaggcatttagcttgccatggaatgtttatctcctggatgcctactttccctcaacttcctcatctctttgttcaaaaatcatctcatcggagaggtcttccagggccaccctgtttaaaatggcaaaccctgccttctcttccaccattatcctcatctctcacacactcattatactcctatattaatttttctccacagttctaattacttttcaatatattatttatgtgacagtttatttgtttaattattgggtatcttctgtcactaggtacaaattccatgagggcatgaaattctaactggtttgctgactgttgtatctaagttgcccagaacaatacctggtacataatagatgctcagtaaatgtagttttaataaatgaatgaatgaatgaataaataaattcataccgctaccctcttcttatctggtctcagtttgtttgtgtcttagttctacctaagacagaagaaataaccaccattcatttccagtgacccttgcaaatggaagatgactatgatataaaatgtgaagtaaattgatattgccaatcagtgtcatcttccccttccaaccctcaagaagtcacctttggtaatgaaacttttctaacattggaatcagaaggataagacttaatatttaaaatgtttagttcaaaacctatttctcaagtacaaactatgtgccaggtcctgtgctatgcacaggaatacaaagatcaaaatgtttctttctatgtgtaaaaaaaaaccatgattacactaattattgcctaagactgtatcccaggaaaaaaaaaaaagaaacctatgatcataaaaactaccttggattttataaaaaagtctaaaaagggtagattggatggagaaaagtccagataataaacgtggaatttgaaactcagccatgaaccaatggtgaccctgatattttggtaagattaatttgtaatgtgggtaatctacatatgacaaattacctattgactacagctataattcttgcctagtatagagactccaaacacattcaggcattccgaagcaagtcaagttcataatactgatttgatttaaatgagtaatttatctttctataaatacatttggttcttgttctcagaactaatattctttataaggtattatatttctctaatagcattaaaatttgagaagtgtgtagtacatgtaaatagccgatacctcacccaagactactcaccagtcactggtaagaatgaaatgattttaaacatgttattattactatttttttgagacagagtctctctctgtcacccaggctggagtgcagtggcacgatctgggctcactgcaagctccgcctcccgggttcacgccattctcctgcctcagcctcctgagtagctgggattacaggcgcccaccaccacgcccggctaatttttttgtatttttagtagagacggggtttcaccgtgttagtcaggatggtcttgatctcctgaccttgtgatccgccggcctcagcctcccaaagtgctgggattacaggcgtgagccaccgcgcacagccaaacgttatttttagtatgctaactaactactaattttgagtagtgcttatattagagcactttaaaaatatacatgacacccttttctttctatttgcttcacaaataatgaactgactgaaagtatgaccaaggtatacatcttagaatgcagtctgtaaattggcttacggaaaattccgtatgtgtcttattaccacattcttctaatatgcatacattttgtgaagagtacctactattcaggatatggaagacttagcactttacattgttactagttacatagaatacatttcaagcatattaacactaacaagaagcccttgagtattgacaaagattaaatttctcattttacccaaatcagtattacaaattttcttttacttggaatgtctgaattagaaaagaaacaattatgtgtagccctgaaatttttaaacttgaatttgacaatttcaacattctagcgatttaaacattaacagtttcatctcctaaaatctgttggagtacaactccatattttctgatggttccattttacctcctcagggacagctcttatattaacaaagccttttctgaagacgatgaacacacggcgagctccacaacgtagagcagatgttgcacagtcaaaggcagtgtctccagctccaagtacaatcacgactccccgtatcgatggcaatggagagtgacaggcgcacattcctgaatgatgaaaggaaaaccccattttcaagtagagaaaccatttctgcatgacagctcaaaagatacttgtactcaaagcagtgtaaaattgcatcttgcagttttccaggatgaagtgtcactatcaaattattctgcttcattgaaagacagttttattcccattttaaaaatatgctcatatatgtaatttcatagtcagtatctttagtttcttttttcttctaggattcctacaacacattttgagaagtttaggtcataacagactggaatcaatcaattaaaactctcttcatcaaaattgtgctatctatctttaactcagcataattttccttttgctagaagaaaaaagtgatccttatgatctgtgttaacggtttgcaatatttcattataatacttttttatgtattaccttatataatttctaacacatacctctgttatatattttgttaactttgaatattaacgtgctgaataagtgtcctttatgtaactgaagaatttctgagaactattttcttgaaatagttcaaataaatctttctccctttcactgctttcctctggttttgtttgtgaaactgggcagtaaaagaaatatgactttctaagcatccatttctcaaggtcatctctattaagatttgctgtccatatgaagatccttgtaaaaaaagtaaaatgcaagtattccttatgtgttaggtagcagtgtataataagattaaataaaactgtttataagatcaattactataattttttaaatggtaccaagaatagaataaacctataatttcaataagtgtaatcattttgcttggaagattttgtatttgggacactctgtaattttcaaatacaagctaggtgcactatgaccttcctcagaaagggtttcagacatacaaacatccagttctactgagaggcagaaggtggagagggtatgcatctttagctgtaaacttctgaagaataatttaatatagaaagtttcttactgttttaagtcctgggagaagcataaaagtttgtatcatttctacatgtaattaatgtaggaatagctgtggctcagacctctttaaaaatatacatttgaaggatttagattatctgactttggataaaatattacaattttccccaaagacaatgactctggtcaggccaaaccaaggtacaaccttcattcaggtggttcttcttggggtgtataaagtgatagggtgtctatcaaagtattttattttaacatcataaaattactgtttaagagaagacagtcaatctttctgcctgtgtagatacaaatcatataagatatgtgacgattcatgccatttctttgaaaaacatcttccaatgtttgttaaggacttgcttaccttgaagcaatttttcatgatgtagtttagacatatatattacagtgaaaattccttacgatgatactttattggaagaatgaacaaacagatgattctggcaaactgttatacccggcctttttttttttaattttacatttgggtcttaggcaaggttgggtgtgagagctgaacaatgtgctgctgagcttgattttgatattaatttatcataaataaaatagcatactcactattaagcataaaagacaatatgttatacctgctttactgcctttggctacaagtggcaaaaagtctttggatgtataaaacccctggtcctgcgtcaggccttggaagatggcatctttattgggttctggcaaacctaagtaatcaaatttataaaatatcattagcaggaggaggggcttttcctattagatattaaaacaaaaaagaaaactttaatctttgaaataatgtcattcttagaggaaaacatctgtaagcaaatcaatataaaatgtacataatacagtctaacggatctcagagtatattatgtatatctttaatatataaccaagtacacatcgtaaatcacacattaatgtatacctataaatatatggaaacatatgtatatacacacataaacatatataacattacagggaaaatcaggttatattcttgcctcatatcataaataagtcagtttcagctacattaaagtactaaatataaaaaaagttaaaaatgggtacatatttatctaattcctgaataagtaaaatcatttcttttttaatgaaagaaaaaaattaaaggaaaaaacaatgtattttgccacaataattcaaccactgctaaatttaaaaaatataaatgaattaaaacgaaaattattaaccaagaagatgttttaataattaaatgtctttactgtataaattctccaaatcagtaaggaacatattagcttttcaatggaaacataaagaataataaaaattgggagaagaaaaaatataaatcacctataagcactaaaaatattaactccattaagtcattaaactgcaaattaaaagaataaaattgtaacttctctataaaaagaaaaatatttaagaaaattaaactatacaccaagggtagacatggaacttgtcatactctttcagtggaaatatacattggtgttcaatatctagaaaatagtcttaaatctatcttaagaaaatactgacacatgcaaataaaggtttaatgcacaaaaatgattaatacagaaagaggaaaataagatgagagagtaccagaatgtcaggtaaatgaagaaattagttttaccgtataaaagaaaaagacaacagaacgaatatttgagaaatatggtataagattgtaatcaaaatacagtcttaaatgaacctgcaggattcaaaactctgtatagtataattcaaattttgtaaaaaaatgtattaatataaaccatgtaatctaaacagagatcatttagagtggtggtattaaggatattccaatttttattatttccttattttccaaattttctacattgtacatatatcaactataaattagtaaattcttaccaaaactttgaaaggaaaataaatggcagactaaattttttccaaagtgtaaatgaagaaaatcttatagcagtcaccccatccaaggcaagtagagaaataattcatctcaattccataaatgcaggggaaaacatgtagttttattttattactaagactcattctaccaatgggtcattctagagaggcaggagtttattttacaatgaaatgaagggcaatggacatttgctggtagatacagagtaataagcatagccgaaggatgacttttgtcatatgagataaggtgggtgccatatctgatctgaaagctgaaggtttctgtgggttgcctgtaatcagcaataaaccaccattgtctcttcagattaaaccaaacatttttcttccccatccagcatcccctgaatctccttttccatagcatttgctcataaatgattttaaaagaacttttgctttcaaaatgatttccattatgtagtagcatagttaggggagccacctcacctgcctttgcctcagcttctctgtaaaggaaatggggataagactgtttcccccttttatgacataaaaaggtatattagtaacagaaacaattatataaatgggtggccgtttatgtgattcttttagaaaacctgggttggagggatggggttggtaaaaatagctgaatatgttcttgaaggctctctaatgacaaaatgatttcttctgaaacctgttaaaagaagactgaagttaggtctacatttgactattcaaaccaacatatacatatgctacatataattagcttttctttccagtttatttagccacaccccaggtcacacatagggcctcaaggtccacggagccctcctcctctacctgggtgacaggtcatcccttctggccagggacagtgcatctgaaggtctccatgtggatactttgatagtctatgctaatcatagtgctgtgggatgatcagaagcagggattttgtcactagacagactttggtatgagtccttcctctctcatttaccagttctgtggtattgtataagttcctgtgaatcctgtgaaggttagggttagatgtcaatttggctaggctataacacccgttagtcaatcaaacactaaggtaggtattgctgggaaagccttttgttgatgtgattaatatctacaaccacttgactttaaggagattgcctcaataatgtgggtgggccctatccaatcaattaatcaaaaggccttaagaacaaaattgtggtttccctgaggaaggagaaattctgtcttaagtctgcacaatcagctcctacttgggagttccagtctcctgtcctgcgctaaggagttggacttaccagctcccacaattaaatagcccaattccctaaaataagtcatctctatctacccatctgtccatcctactaattatgtttttctggagaaccctgaaattgattttccactacttcatttctaaaaacagagataaaaattctacttctctcatggatgtgagattttttaaaaatgttaaaaaaattacaaaattatgaaaatattaaaaatatatccatatggataaaccatatatataattgagagctggcacatcgtgaatactcattaaacattagctattaatattaagataggtttattctataatttatcaattatttcatacttcatattgcatggcaaggaaagaataaaagcttaaataaaaataaagtattaaaccttagcatatgtaaatcaagttccacaaagaaagaaaaatgaggcaaccttaagtgaaatatgaaagaaaatgaaacttgcaaatagtcatctatcaaaggaagacttctctgagagtaggtggcatattaataaataaggtatgtgtctatactaggatgatttcaaaatgacactgaaatgactttttaattcacctttcagtgtgaaaaagagagtttatgaataaagatgaattgacaaagatttgacaaacaaaacagttcagcgtagtagatatgtatagtctttgtctttcaaggaggccggatagtttgtttctttagaatagttattgaagtttttggtgttttagcatgcatttatacaaaggaacacctccttaagaattatttttaaatggtgattttcacgttctctgaaaaagaagggagggagggagggaaggagggagggagggaggaacgaaggaaggaaggaaggatcctgcttatgttacagaaaatttaaattaacttttattgactacagacactactctaaatgcctggcccccaggtgattattatataactcattttaattctcaaaataattgtatgaggcaactgatgttattatccacattttaaatatgaggaaattgaggcatatagggattaagtaactcgctgaaggatcacagaacatgtaagaagcagcgccaatttctaacgtggacactggttgtagagtctatgttatgagttcaaaatggctgcctttttcatgtttaaggttataactaggccaggttataatgtgaagctacataaccagtcctatctaaagtaatcattcaacatgtatgtattaagtttctctacaaggctgcagatatgcgtacctcacaggatgtgtctgcagccaggttccaatctagtgacagagaaaggactggctgcttctcttgtcagcatttttgttttgtgattattttctccagtacaatccctttctgaaatgttttccttcttaagtgaattcctcttgggtatatcctggttatttttcactatttgatattctttgaaatgtgtatccttgcattgttgccaaagcacctccctctggaacaactacagaataaataacagcagtatatatagtaaattctttccttgtgctcacataaagttttgcacaacttcagttaacatgaacaagatattagatgttctgttacatattaaaatctaggaagtaataagagaaaaaaaaaagcttttaaggctttgctttcatagctatggtagggcatgtttaagaattactcagattctataatgtttgcttgtgttacttcaccaagccacttgtttagtgttaactgaatgatgcaagcatttgtgtgatgcttcctgtccttgaaaggattcatctgaatgacagctaagccatcatgagaaagacagtcatctttggagatagactcacaaatcccaggtgtgaagaagatagcacagaccacagagaaactacctcaggtccctggccaaaggctgtggctcacagaaatgggtgatgctggccagtcacggtggctcctgcctgtaatcccagcactttgtgaggccaaggtgggtggatcacttgaggtcaggaattcgagatcagcctgaccaacatgacaaaaacccatctccacaaaaaaaaaaaaaaaaaaaaaaaaaaaaaaaaaaaattagccgggcgtgctggctcatgcctgtaatcccagctattccagaggctgaggcacaagaatcgctgcacctgggaggcagaggttgcagtgagctgagatcgcaccactgcactccaggctgggtgacagagtgagactctgtctcaaaaaaacaaaaacaaaaacaaaaacaaatggacaatgctctagtatactgaactctacaggaacaccaattcttattatttcacacaggtgctttttcaataagactttggtagacaaataaaacaacactgattgtcactactctcaagttttctggatgagatcagcaaaatgtagctgatggcaaataccgtaagtttttcaccttccaaagtacttttgtatgtgagatctcacatgttatgttactcagtccttattttctaatgctggcttgggaaatggtgctgcattagggacagtattaaaatatacagattaaacatgtatttatggaataaaccaggctaacttccccctctgtcttagtaaaagaaaaatccatgtaacaacttttgtctttatttttgtttattaaatcttataaaatatcttaaggccgactgacctatttgtataattatttgtaaacagtatactggataggactgaaaactctgaagtcagacttcctgcattaaaattctagttctagcacttactagctattatgaccttggccaaataaattatactttctgggcaacagcttcctcatcacaggactgttgggagaattaacacgaaaaacaggtatataaagctctttgcacagatgtgaaataaatgtttcctttaattttctttgcttccttaaagcctttgtttgacttaatgaaatgatacgtttgagtacatataagttaaatgatcatctaatccatgatatacacagtttatattattacatatttaagtggtcagtattggataggtagtatcacagtccacgaaacttagcatctttggctaaaatgaaaggatgtagccacataagagtattattctaacttcattcattctatagactacaatgaactccagctacatgtgcatcaaaacaaggaaagtattaacagcaagataaagtccactcctgctcaaagtgtcattcaaattggagcattaagaacaaaatcatgtctcagacagcattgacctagggtctaaagaactgggttctaatctcattatttccattttctaactgtaattgaataaaattgcttaatcctgtggctttcaaactccttgattttagaatgcagacaaccctgcttactatacagggttctttggaaaattaggtagaaaagtgcacataaagcatgctggtaaatctaaaataacattaaaatgtaagtcattattactgtctttggtaaaatataaaaactatgggggaaaaaggcttacatgataaagagattcataataaacactttcaaataaagaagatattgcaaactaatcataagccatttgggtggctgtatacaggatgtgtaaaagtaggtagaaaatcataaatatatgcatctatgtatatatatgtttatatatgtattagagaagataagctattcctgattcaagcccaagcagttgagattacaatatggaagtaaaatattcctttcaagtgtctaactaagcatgtcgcagttccacaatggattataaagtgtttcatctgtcacttaaagatcactcaaaggatttatgtcttacttctaagggacaatagtgccatatgggttatcattctaggatctatatattgatgagaaagagaatagatcaatgatggcctattgtggttcttttctcaataaaactccccattttcttcccgatgtgctgctgtaaatgcgtttagtactgagtgttcagacagaatgcagaaaaaaatggagtgattcaatataacacatatgaaattagatcaccatgcatcacaataatattcatttcattgatttttgaaatccccattaaacatctgtttcatataactgctgtctatactctttctctaaatgtgaccacacacattaattgtgtgtatcacacaattggttagagaataacaagaacatttttaaaaatgttatgaatggagacaccatttaaatagtatttttttccattacacaagattctttttgtacaccagcacataacaataagtccagaaccaagtggattactgagtattattatatcattttgaaaatctgatacatgctgaatttctctttgtatttaatgtataaaacagtacaattttaaaaagcactagaaaagagaataaaataatcaaataatttttatgaagttatagtatttcaattggcttctatacttcatgtagaaaacacacaaattctatcgtgccaatgtaattacttcacctaacttcatgttagaacttatatcagacttcaatttagaatatctacaggtgagaaaggatgtgaacatattctttataacaaagcaatgaatgtattaagaagtacaagtacacatatgaaatgaattgaatttgagtggttgaaattcttatagaggattttttatctgtaataaatgtccagtgatttaatacaaacacaatgagaatatgggttcaccatgcatttttggtctcatactttttacttcctttatacatttggaaaaaatacatagattttattttgtttaacaaaattatggctttctttatggagatggataaaatatccttgagtatattgtacttttataacagatcatgtctatattaggatctgttgcatcttttcttctatctataggacattatgacacaatgagaacaacaaaccctttggacaaaaaaaagaagtacctttttcttcattattattttataatattgcaatttgcttataattagtagaagttattgcaataattgaaattatactttaatataagcatttggtttagttgaaacatttctagaaaagatgttaatgtaatttcatatttcagccataaatttatcctcattactctgctttatggtattatttattaaagtatactttgtctcttgagccttttctcttctccttttctttatttccctcccttctattttctctgtttctttttctcatttggcttttgctataaaacaatttccttaaattttaatccccgcattgtgaagtaagggtaagcaaaaatctcaaacaatacgcctcaggcaaagattttttttcttaatgattggagttcttagatagtgttaggaaattactgtttaggactgtgtaagtacactatatcccaaagtaaagaaatcattaataataaaatactaaaaaggaacagttatattacaaaataaatcttccaggcttacaaagaaaacaaatttgcaacagccacctgctgtggagatgaggcagtaatctcaacagcaggaaataaaaggaaagagaggagaaaaatacaaaagcacagacattaaaaaagtaattaaaacacttatctccatcgacatacataacggaaaaaaaccctcaaccaaccacctaaaaacatactctattgaactgcacagtaggaaacagcattaaagctgccaccataaacacacattccgtagaaggaagaagacccctttaaaaatgtaatatcaaaagtattactaaagtgttaatcaccagtaaatgtaactcacattcattgtattgtattagttactttctggaaggcgtttttaaaaattgtacttttacattttttactcaagtaaattcttaaacacaggcactgataacccctttatcagtaattgttctagcaaattatacaatcatattgtgagactgaaacattctgtatttgaaaaactttatgtaataattgttaacatatcatgcatcttgataatggcatttaaacagtttcctttgaagtaaactagcctttgctatagtactggaaaaaaatgaggtgaaacacaatgtatgagttagggtcatggattaaaacggaaatgaaagctaagaatcgttctgaattactcatgtatgctctggccttcagagctctgcaaagtgaaacaatgcaagactgaggaagcaagtggcaggctttaaaataaagaacatgtagcaaacgcgcttgtgactctcttagctgctggaatttgttttctacatctatgtgattttctccaggcatatatgtgaaacgatggagagctgctcagttcagaaggataagatctctctaatgagctcttggctctgttacttatatagctataaatccaagcataaataattaaactttaagcctcagtttcctcatctttaaaatgagaagctacaaaaccgcatctccttatagaactgttatgtggacaagtaagcataaaatagctctgtcatactgaaataattttataggtagaaaatgtaattcacaaacatagaaatttgtcgtgctaccatataattattttatctggtgataatattcatcgatcagtgttatttcattttaattctgcattttcttctttaaatgataaacttctgtgcaaatttattttattttactctaagtcattactgtaatttcataagttttccaaaaaaattactgttctcaatagatttttacaagaaatatgttagatattagaaaatatgaaatcattttcatgcataaatatacttggaatatatttagtattactgtcatattgctgagacttaaaatcacagtacttttctaggaattcagaaaattccacaagaaaatcaccttctaaagggcattcttgatggatgcgcttggtcaacaattccagaaacatgtttgacctttttgcacctcagtttcttcatccataaaataggtaaatcatctagaaatggagttctgggccttgtctgtgttttttacagactccaagactatattaaaacagagtaccttttagaagtatgcattttattgtgtacagagggctcacacttttcatgacattctcctaggatcctgtgactcaaaaataattaaagaatcacatttccccactctagcattaaatcaattacactataccatatccaaatgtcttttcaagtgtacagactatggctgaaaatgccaaatgcactgcgattttccacatctaacaatcactacatacctgttcataaaagaaagaatatctgtttataaaagaagttgtaagaatattgggtccagtgtaagcggaagcaacagtttttaatatcagacatccttatgttcatatcgatatgtgatatggtttgactgtatccccacccaaatctcatcttgaattgtaatctctgtaatccccattaattctcacatgttgtgggagggacctggtgggaggtaactgaatcatgggggtgatttcccccatgctgttctcatgatagtgagtgagttctcatgagatctgatggttttataagcatctgtgatttcccctgctggcactcactccgtcctgctaccctgtgagtaaggtgcttgcttctcctttgccttctgccatactgtaagtttcctgaggcctccccagcaatgtgaaactgtgagtcaattaaacctctatcctttataaattatccagtcttgggtatttcttcatagcagcgtgagaaccaactaatatactacttcactataaatactagctgtttaaccttgcataatcacagttatttaaattttaagtctcagtctcaactataaaatctgctctgctgggatattaaatgagataatatatctcaatagtatgataattgcttagcatactgactggcatatggaaaatgttaacagatgaactgatcttgatgtacttaaagcttaaaaaatctattattttcatatgcatacctttcttgatattttttcttccttgatatttaacacaattattatataaaacaccataaaaacaactttaacaacaatgaaaactatggacactttaaaacattcagtcccaattgaaatttccttgagtattggtgattaagcatacaaaacttggcagtttcattgtataatcattatatatctagttctgaaatttttgttgcataaaattattttaaaatagtctatcatattcaacttttggatctggaaaccagcttgatgttttaagaatcatgaggacaatcagttggaaatacaaatcctaggtattaatttaaccacttattcattaatatttactgaatgcctactacgtgctaaacaccatattaggtgatgaagatacatagatgagtacctactatgtactaaacaccatattaggtgctgggaatatatagataaatagcttctggggtagtaggaagaaggacatgtaataaaaaaatttagaatagagcaagacacctgctatgagagaaggatgcataggttaccacaggagcagttacaaaggcacttcacctggactgcagacaacattctaaagctgagtcttaaaagattaatgtttccagtcatagaaaaagggggagtataagcttcatatacaagggcatgatggggtatgagttcaatctgacaacaactggggtatgatgaggggagtagataggaggagacaggaagaagcaaaatgcgaaatttgacaaataggcagggtccaaactatgaggggtcattcaagtcacaccaggatgtttggattttacactgaggaaacattttaggaaatgatataatcagctttgtacattagcaaggacaaattggtagtagtatatagaaataatttgcagaaaataagaatggaagaaggtggatataaggggatactgcataaatccagataagaaaggaaaacttctcttcttcttcttaaccaggattactagtaacctccactaacatggcattgcagggggtatccatagcttagtataaacacagcttaccctcctggggcaacaatttcactcaaagataagtaacttaaattatagtgttcatattacgacaaatgtagagagactgaaaaatgagatgcaaattttgaatgaaattttaatacttcaaagacattctatatatggcattcaaaactgtgcctccagattccctagaggtatgttttcattctcttctcctattacagtaacttaaatgagaaaaaatagcacttatactaagatactgacagtggggatgcagaagaataaaaatataatctcaatatatttaggcattaacttcataggatttggtcccttgtggttataaatggcaaggtcaaagctgagtctcagctttctgttgtatctcaatagcctatacgtccttctctcatagcacatgtcttgctccattctaatttttttttattacatgtccttcttctactgcactgtgattcagtatagtggaagaggggcagattctaagggaagagtgttgttcctttttggacatatttaatggagtgtggaacaaaaatctgaagctcaggagggaaatcccgtctagataaacagatttgaaaattgttagcaaaaaaaatggtgctgggagtcagagatgctaatgagcattaatccagggagagcgtatacaataatcagaagagaaggccaagaggggagcataagataacacacataccttaaggaaggaaagagaaaaggaagctaaaggagatattgaagaaggaccaatcagtcaggaggaggggtaggaaaaagcggcatgctggaagtcaaaaaaagagaggtatcagctcaaactttcttgttatcacagaagaaaactggatgcaaaaatttaaaacattatacagcgcataacactatgtacactgtaaagcacaaacagtgttcaaaagaacacttttgattttaggagtcatctttcttgatttttcagtacaatacatggccactagcctacaattaattttagaaataatataaacaaaaaagatttattgaaagagaatattaaacagaacaaaagcaacaaaacacaaatacatatattgtaactattagaatctatttaaatgagccaactcagaagaagaaaggggaaaactctataatagccacatggggaagtattctagtggcaatgttggacaagtatgaaaagaatgaattggccagaaggagaatacatcacatgaaatcccaggaatcagtacaatggagaatatattcgcactggagcactttctcaagaagtaaaaattaagtcagtaatggcaactgcacatcagttacattctgagtaaataatataaaagggacataacttaatttgtgtaatatttgtttgattaaaaactacatttagaaaatattctcttacaatcttaaataaatacatcaaaactaaagccctgaacaatggaggtgttgtttttctactagtgggtttggaaatcccacagaagggtacattcacgtctggttcaccctaccacagattttctgacctctgaaaccaaaaccaaataaagactcctagacagtagaaatatatgggtaacgtagcgacacctaggtttgctctcggtttccctacctactagctttgtgatgtatggcaaattagcttacttccctgtgccttagtttcctcacctgtgaaatgaaatgtttagtgcttcctcacctgacctaagtgctcttgaattatgaagcatgtagacagatatgagaaatttaataataatgaaaattattttcattttaattggagcacattaaaatgtacattaatatgcatttaatataaatttaataatacacatataaatgtatattaatgtgcaattggcaaacagtcatgttttgatttatcccactactaggtgaagaatctatagcaacagttcatggtggattaattagggagatcaaatagaaattctcagttgctgtttagaaactatttaagttcactgtaaactatataatacataccaattcacgaattatactaacatctgaaccactctaatgatagtatagagagcatacattttgacagaatcaataaaaatctcacatttttaaagtcaatgtaaaataatgaattacattccaaatgcctttggtttaataaactgagcagtctgctttgatactttcttttcagtttctgaataggtaatttctatgatgacatatggttttagggccatttttaatcatttgtaaatacgtttatattttttaaagaaggcatattctaatgctaagccatgtgattcatcctctaagaccaggctgtataaagggccactaccggcaatgaagtctagttcaatcagtttacattccagccacaatctagactcttttgaaaccctaacttgctgttttgtcaatgtattctacagaagataaagaaaaagagagagaatctaattcagaaggtctttcaccactaactgtcttaaatataggctcaacattatacaagctcagtaataataaatattttaaaactttgcatttgtaaagtgatttattacttaaaaatatttcttatatacttgagccccacaaaaacactatggactaggtatccttatgctcatttacagatgacaaactgaggttcaaggcagtaaaaaaagctttctataatctcacagacaagtggcaaagacagatttaaaatagcaaaaactgttaaatacatcgtttcttccatcatttcataaaatatactttagggcagcatttaatctttattgttagagagagaaaaaggaagcttaacctagtctgaaaatttggcatacaatgctatgtggtgcttgaatgttaatatagctattttattcataagaaagaaaaaaatatgctttaaagattagtaggtaattacttacctatcatcccacctacactacattttggaatgattttaggtaagccacacccacttaaacttaaatggcgtcttgtaaaagtatcttctaagcactactcatttgtttaaagcacagatctacaatgacaaaaatcaattcattttgagaaagaggtaataattaaagtgttatttttcttctttcactgcaagtcatttggcctatgttaaatcaactatcaaattttcattcattatttctacatgaaggattctgccagctcaaaaaagtataaatcttcatttgacaaatttaaactataactgtcccagatgttatcaggcctcatagttcttatcccttaaaaacagcaaaatattgtcaagtcacaccaccccccataccctcagataacccctggaatcaataatatttgtaacttgtaagtgcacggttaaggagaacagaaggcaagtgctgtcctcgttaaccacattgagctgtgataccacagccgactcccttgtgtgacctgtgatcaattttaatctcctgaccaagaataaaagagtgcagactcctgattctggattcatcttgaaaggagattatagatttgcatgtttgcagtgggaatgaaagatttaattcaactggcatttcaggaaagaacacatctaaactatcattcctcctcatttaccctcactgcttccaggtcctctattgacagaactaaatactgaaaactgtgtacgcgatgggttaaaaagcaaagctatcttcgtggacatatgatcaaataactacagaaacagactccatagtgatttcagtacatgatttcagatggaatcagatttttgtatctcagatttcagatttctctataaagattacaattttttgcccaacttcttcatgtgaaaatcctatttttaagcaattaaagaattcattgtttgctcaaatcatgattagctgcttacaaaatacatatatccaagtacattgatacatctggggagctttaaaatgcaaagtaaccgtgatgtcagaaagaggaaagacattaccagttttagtttcatatctctatttgtaactatatatcggtgtgtttgtgtgtgtgtatatatatatgtgtgtgtgtgtgtctgtgtacgtatgtacaaacatacatatgataatagatgtattcatccattttcacactgctgataaagacatacaggagacagggcaatttacaaaagaaagagacttattggacttatagtaccatgtggctgggaaggcctcacaatcatgccagaaggcaaggaggagcaagtcacatcttacatggaaggcagcaggcaaaaagagagcctgtgcagagaaactcttgcttttaaaaccatcagatttggtgagacccatttactatcacgagaacaacacaggaaagacctgcccccatgattcaatcatttcccaccaggttcctcccacaacacatgggaattatgggagctataagatgagagttgggtggggacagagaatttcatttgggtgataaaccgtatcagtgagtttatacaaaaatgcacaaatcttatttttctatagagagaaaaaataaaatatcttattgttgaaaatcaagtaaatataaggtgttctaggaggttacaggggcaatccatgcaactgcaatttgaaaattctataattagtattaaataactttttctatacatcagataacatttccaattccacatcatcacagcagttttcaaacattcacaatgcatcacgtactgtgctagacaaatccgagccagaacctaagtttgagtcctgactctgctactttccagcaagttagcttaccatcttttactacagattttttcatctgcaaaacaagaataagatccttaatagcactgagattaggattttttgtaatgattaaatgagataatataagcaaacctagaagtagtgctcgtggtacttaatagttactacacaggtgttagttgtagtaaaacgtattctgattcattcattcattctttcataaacattcatcactccccgtgttgcaaggactgcgttaggaaatattctcataactttattgttaacataaccttcaagcattagtttatgactagaagatgcatgagtggctcatgtgtaatctgggacataatgacaaatatttaggatgtatcctatttccacagatccccttatgccctgtattgatattaagtggtattaaaagtagagagggcaaaatagaccaacttaatatggtgttgcatttttaaattcagcatattaatgcaatatactattgtctctgtggagtttcatttcacacgataaaagaaccaggaggcatctgatcaataaatagaaaatcaagttatatgttcctgttagggtggtctaacaaggattaatctcagaaatgttggtgcatgcctaatgctgtggcttttaatcttttcacacaagtgggtctaaaatacttgctattagcactaatgtaaaaaaaaattaatactttacatatggctatccactgtactcaaatgaaggggttaatggtaaaacaagcctttaaagatgtaaatgattcctcccatgtggctgcaaaatagcttaagtgtttgccatctaaaattattaacatatagaaacattattatctctgcagttaatatgcacctcactgaaaatctcatggatgcaacaattaaggaaggcaccatccttaatgaagttataagacatatatcatttattaagcagcaaataatatctttaattttggctttaatatatctttaattttagctttaatgattatatgcaaaatgtcttccaaaacctcaggacaaattataccatagcagttgggcttgtttcttcaatccctcatcctctatgctgcccccagtgctgagcaagagttgtcatttacctgaggcttcctttctatgagcatgtgcttctctgaaatactgagataatcaaggccaggacaacactacatggatgttttttcattaagagtttatatctaattttgaaattttcttactgattattatagagttttgaataatctagaatgaatgttatccatcacatttttattactaccctaaaatgctaaatagtagcataaaaatattgaaaccaagttgggcagacatgtcttttctctctctttccctttctctctttccttttttctgcccttcccttgattccttccttccttcaataaatatttattaagcagccttcctgtaacaggcattgttctctaggcaagttatctaaatttgtttaaatcatatactaattgaatgtaaagtctatttgtacagtcaaaagataattttggtggttaatagtcaattgagtttaagtctgggaaccctctttcctaaggaaaatatttcctttatcacactctttgttcagtgtgctcataaaaatcaatcataactctctgaaaatgatgagaaaaaaagagtggacatgtcactaaaatctttaataaattttttactcttctgcatcctcatatttatcatctgttttacataaactattgggtggtttcactcacaaaaagtccttaaatgcgacatctagaaatctggggcatactgagtgtgctggtgagactttccgaaacacctgttttcaacgcatgatctgccaatatgtgtttaaatttgttcatttgttcaatatatatttactaattaaaattataaatggaaagagctagagcatgaatatagcgtttaagtaataaaatgaatcctaatgtacagatttttaggcacaaaggacatgacagaaataagataaatagacaacaatgggtatgattatgtattagcaaacatcaataattagtaaaggcacaagtagaaaggataatgtcatagtggcagtagctacagagatcataaaagtagcagttctaccatgttattttcctttgtgcatacatacaatattataacagtctttgaatttcctttactagctcatccttttatctaattatctggctcacgaagagccagggggagggatggatcttacttgtaatctcagcaatttctctcattgagttgatattcaagtaactgaaaaattttatatagcagctaccgtagttccacacatggtattgggatatggtgatttaaaacttaattaatatttttaaatgaggcaaatcttcaaagtttattaaaaattttttaaagttttatgacagggtgtatcaaacagaatccctacaaaaaataaatgtcacacttaaattaggataacccgagattttatttactaaagaataattataaagatataggtaaggtgttaaggtactacaagagttagagacttgagctagaagaattagtttaatatcaatgtttctgatgaataatttaaatacttttactctgtgttttcagtagatcaagtgttgccttaatagatattatgtgaatgatatttataagactgagttgatttcccccacaagtttgacaggataaaatcacacataaatacttttaataaaaccatagtagactagagataaaaggcatgtcaaggacaattagcccctagaaggggcttaacaagtccaaaattttatagctaattattcacagagatgaggcctaaatccagttagctaattctaagttccacttcattttcattagcaatggagggaagcatcacgactactcactaatataaatcaactatacatcctccccacccatcaagatgcacacttttcaatatgtattttaaaatctttaagtatgaatgtacaggattatttaatgttacaggttgaagagacattggataccatgaaatatcattgtctcattttagcactgaggaaactgcagtctagaaaattttacaattcttagtgactaaaatctagttaacagcaaagttaaggcttacagatcttctaattcaaaaatcaatgctctttccacaatcaaagccgcctcttttctctgccttatttattccttaagactgtaggcttttaaaatccagggcaatatctagtttttcatatatgcctaaaagatctagcttactcttaaactatgcaatactatttgaatactagtgctaactatgattaaagttagcacacatttggaaacttgcataacactgctaaggtctctaaccatgagtaagacacaattcttgtttacaaaaataaaaattcataaacccatatatccagttgtccaactgcttactgaacatcttccactggttgggctagtaacacaacaaattcaagatgtccaaaatgcgattcttcattttcttctccaaatgttctattattcacactttctgtctttttgaactatgagatgatcattgattcaaaatatattcatagagcacttactatgagctagacactatgctgggtgtcgggaatctatgctgaccaacagtggggtgattctgaccttcatgtaaaacatgacaaaataattggtaagtacaaactacataccagctatgcagattaccaagtaacaaacagaaccatcctacacaactccctctccatcaaacttcatttctacaatcaccaaatcctattcttttcacttaataatctttcaaattaatctcctcagtctcactaatattgcttaggcccttatcttttctatcctggctgacaaaaaaataacctcccaaactgatcttcctgcttctttcctctctgttggtatcattccccatcatgctggcagataagtttttctaaaatgaaaaattcgagggactccccagtgtttcactccttagcaaggaatataaggcccttcattatttgaaccttagtctcatctcccccaaccccttcagcaattacacttcatttctgataaaccaatttgaattctgtcctatagtgcactgaatacaacattccccttcattacccctgagttaagattccctctgactggcatgcccttccttccctcctttgcctggcttccatttaccttgatccttatgaagcatatgatacgttaactcctctgagaagactgacagaccactgtcactccctaccccaaacagaaatagcagattcctaccatgtgttcctcctcttcattatccttacacccagggtttgagtctattttattggtatttacactgcactctaataaatgatttttttttttgtctgggaactctttacggagtttctgctttgttcttctcggcattctttctgcctaggacatactaggtattcaattaatgttagtctaatgaaggaatggtaaattcagttttcatttgttcattttttatttattgtcacacttttctcagcatcataaaagaaaggttccacacataagtgagtaaatcatccctttctttttaaatatccaaggatcaaaatgtaatttaggataatgagattgaaaattattccaagtcaagaataaaattcttattcaaaatattatctttttgagacagataggattacattaaaagaccagagagaccacacggagatgctggatacttacctattgttcacttaattattcatgcaaactacttggatgttttactaaaaccaagatttgcaagcatattaatattataaacccaagaatcacaaatattaaaaaccgtctctaaccatgtagctcaaattacttaagtgcttagataaccgtgataacacaaaaaatagagacctagttcatacaaaaaagaagaaatatatatcctaggtgaatgacttgtacaatatgaaacacagcaattataatttttaatttcaattgtttatgttatgtacaaaaagaaaacttgaagaatgaatatttcactattgcattaaaattcctaagattattagagtagtgatttctcctaaaattaaggctatgaaagttttatttctttttttttgagacggagtctccctctgttgccgggctggagtgcagtggtgggatctcagctcactgcaacctccgcctcccgggttcaagtgattctactgcaagaccatcctggccaacatggtgaaaacccatccctactaaaaatacaaaaattagctgggcatggtggtgcacacatgcagtccaagctgctaggaaaattctctttctttcttttgtaaatgatccaaggatctaattcccacatattcagatggggcataagtatgaagaaaacacacatacaaacacctacgcatacacacacacaaacacacagttcgtgtctacaacctccaaacgttctttatcagaaccacaagactgttctaaaatgtctatacaaaaacactcaactatccatgcctaaataaaggtaattggctagggactactgatttcaggcaaatatatttttacaagagttacaaaacactaagcaacagtggctgtgtcagactagtcagcctgtcctactcatatttgtaagttagtaatttaaaaagctatttggcttaaataaaattatatttacattggaattcttagaactttagctttgctggatctttggcttctggtggtctctaggtccagtgaaaaacaccaacattgagagtaagttcagggtgaggataaaacatctcctatgaactagggatacctacaaaatatttgcagggagattctatctctgagagaggtgctgtggaggggttgggggtgtctgctgacaggcactaggtggagtgcatacctgggaaacaagacttgtcaaatcattgctaccaagcaaggtctgcacatctgcagcatcagcaccatgtgagaaatgcagaaactcagactccacccctctgagtcagagatggatgcacatctccaggtgattcctacacgcattaaagtttaagaactattaaaccatgagttatcacctcgaaataaggagaaacttttatgaaaagaaggaaaaagtctcaagctgccttctcttttaaaactctctcagtttgccacttgggtccccaaaatgtaagtcataccagggtcagatctgctgtaggtctgataactatataagaaaccaaatgggcaagtatgtagagaaataatttttatatggtacagtagacccctttaagtgttgtcacctgaaaggtataaaaatcattgccctgccttgctttttgtcaaatttcaatgataaggacattaaagctttgccttagtactgttctagatcagtgtttctcagactctccatggcaagggactagtcttctttcattccaatccttttcaattattttttaagaaaacaaaaataaattactagaaacagaaattgacaaaaaaaatcacaggcatagcatgtcctgacattttattacttgattcattagacatgtaattattctgtcaaggattttttttctttttttttttttttctagatggagtctggctctgtcacacatgctggagtgcagtggcatgatctcggttcactgcaacctccgcctcccgggttcaagcaagtctcctgcctcagcctcttgagcaactgggattacaggcatgtgccaccatgcccggttaatttttttgtatactctgtcaagtttctataaaagtttctaaatacagtgtgtgggcttatctcattacagaccagtaataaccagttcagagtccggcgccagtctatggctacacaaccagcagcattgctatagatgacacagaatttgaatttaggtagatgatacagaatttgaattcaggtagccacacttcagaaataaacgtaggattttaatccaggcaatcaggcttcaaaaccaacagtttcaaccaagccaccatcacagattaatgaagggcacggggttccttgcccatagcttaatatggagttttggtgagctcaccacataaaatcgaaggcagtgtagatagaagaaataataatgcaccagaaacatccaggatgcaatcttgtgtctcatttctgcagtaacagtaagtaatcttggtgaagatgtttttatttatcttcattcctttttatgatttttgtttctatttgatgtggatatccaccagactgtaaatggggataatatatcacacaaccaggttgttataaggattatatactttggtaaaattttgttgttttatttcatacagattggtaaaatttacaaaatcttacattctagaaaagtgtagtcaattgtttagtttcaaatcaattaggtaatcataaaatattttcctttcttttaggattgctagagatgcctaataacattatttctactttaaacaatttgtactaaattatatttaagtatcttatttatatcaacctgacaactactagcttatgatcaaaatggaatgctggttgacaggacaaaataccatgttctgtttgattcgcttgtctttagcatgtagtaatatatagagataacaagttagcaactttccatgaaattggacttaagcatacgtttgtacttaattgttcagaatgtcatatgagaatcctgaaggaataatctgcttttctttcaaatgtattgcctatattaaatccgcatccacccttttatcaatgcaagggaaacaccggttacaaagttaatgttaacgaccattgcttctatttttataatactgactagcataaaaattcaagtaatcatgcttcttataactttgaaaaatgttagttttttccttgctcttggtatcttttgtgattttaccattacacaaactatctaatttcacttagtttctaggaaatttgaaggtaactttttaaaatggatatatttaatatgaaaacattattttctgggcttaaggccttaaagtattgccagtggcatttgtgcctatactgtttgacagctttttctcatgttgaaaaatagatttgaggaagttaaatcaaattcaaacatctgtgattgccatgactgattctaaatacaaaaaagctgaaagctgtaagaaccgtttttagccattctttttcatttaattttaaagttcggcaaaatctcccagtataagtgaaaaaaaaaaaaaacataggcactttggaattattagcctgggttacactcagattccagtgagatttggctgcaatcactattccaattgatacacagggcattcatcttaatgttctgccatttactggtgttcccatacccattttgaaggcatttacattttctttttgtccttttaaaaaaaatttttttgagacagtgtcactttgttgaccaggttagagtgcagtggcatgatcgtagcacacactataacctcaaattcctgagcttaagcaatcctccagcctcagcctccctcctaagtgggactatcggcacatgccaccacactccactatatatttatttatttgtagagataaaggtctccctatgtttctcaggctggtctcaaactcctggcctcaattgatcctccccgcttggcttcccaaagtgttaggattacaagtgtgagccaaggcacccactctcacatttagatttcttactggcaacatctcataggttattaaccatctgccctcttaaaattaactttttaaacatagttggccaaaatttatttcagtgaagtttcagataaattacaatttctggatatctggacaggaatccacatttaccttttatattgttcataattttataaattctattcgtatatgctctttcattcttcactgtcccaaaatgtaaaagtccaatcttcttagccttccttcatacttctgcccctatctaatcattcttttagcaacttctggttccattttgataatcattttttaatttaaaaaatcagcttcctacttgtacatggattacagctttatttaacaattcgataattagataatgctttcatcctcttaagagatttatcatgaaataaaaaagtttagcatttcattcaaactcagctatctaacaatcagcatatttgtacatatactgtacaagcctgtctaattttataatgatggccatgtcagcactgcaagaggctgtaatgccttttgaatatcaaaagaaatttagatttgattgagtatattaactattttggagactcatcaatagcatataggacctactataaattcatctttattctaggtcctttcagtagtacagaaacatgctaagtatctggcacttttgtatcattttaaacataatgaattggaatggtggtatgaattaataattttaatgaatgtaaataagaattgaataattaagtaaactgatagtagattatgggagtcaggtgttttcactgttgtattgggaggttaaatgtaaataagaagaaaaggatagagagaggctacaatggtctacgtggtgatgaattagagtggaagacatcagtatatacacatgtttcatttaatacagatacatatggttaaagaaatatgtatgtattagcattttattcaaaaatcagctatctaataattaacatatttgtacataaataatataagtctaattttgtactgatgtccacatacatgtatatgcataggttagtatacacatatatattcccttacccatcagctgggagggcctaacaagcaataacatcacagtagcaatgagcacacttagctcccagatcttgatttctaataccattatccaataaaagaaatcagggcccccttggagaaacacctgattctaggacttaggaaggaaatatacaagataagcctagatcatcttgtagggccagaaattaagtgctaaaacacaaacacacactaatgcatgcacatacacacatacacacgcacagatgtagatatattaaagggacacaggagtaaactaaaagaactcccaatggacacagccagaacaatttgagcaacaaaacaaagtgatattagtttacagcaaaaagtaaaaaataaatatccacgagtccatcatacttatataaataaatgactgaataaataaatgggcagaatagacaaattcccatgcagatgaatcccaaatgatttatgtagatactctattctcaaggaagtggagcataattccccactcattaggtgtggcctgctcatagtggctttcttccaaagaacatgatatgcaaagagtcataaaagagtaattttttagtggagaaacctgacatacactatgttagtcatgaaatcaaggttaacattaatcatgacaaagcttattgatagtatataaaataaggtgatttaaataaccctttacctctgtggtcttctgcccaaaaacccataaccccagtttaatcatgagaaaaaacacatataaatgtcatttgaggaacattctaaaaaaatacttgactagtaatcctcacagctgtcaaggtcatcaaaaataaggaaagtctgaaaaaaccattgcaaccaaaaaaaagcataagaagacatggccactaaatataacttgggatcttggatagactctaggtaaaaccgaccctgggtaaaaactaaggaaatctagcaaatgtgtggaccttagttaataataacgtattaattctggttcattaattgtaacaaaaacatactatactaatgtaaggtgctaacaagagaggaaactgaatgtggactccagcgattctgtattgtctctaaagtaactctgtaaatctaaaactgttctaaaataaaaaagtttatttaaaaagataccgaggaataaaagactaagttgcatgaagtatgagtttctatacaagactgtatataattagatgttattttatgcagtttccagtgtggtgaaagtgaagaagaaaggcaggcaaacaagatctgaaggaatcaggaaatagtttcatgaaaagaatggcgtttacacagaatcaggagagctaagatttgcatatgtgaagttgagaagggagtatcatgatactgaagggcaaaacagatgcaaagacttcaggcaaaaattatttaaaaccacttctcaagaaagtgggtatgagataggactctggtcattctagtttccatcaagctgggcaatgttgaaagtgaatggagttagtccaaggatattggcaatgaccagtgactcaagaagcaaaggaatgctctcaagaatcatgaccaaagactgtgaagcagagaggtaagaattaggtgcaaactgaggggtgtcccccacaaaaaagcaagatgaagaaagcagtctgaataacaaaggcaagccagtaaagattcctcatgaatttccccacaaaggagaaaacacataatcttactcataaagctagagcaggctgttaaatgttctcttatggaaagtaaaaaggatgttcagtcttcagcaaacataattcactgcagaataacaggaaataaatttgggaacacagtgttcaattgttaccaaggcctcagggagtcaggcatagtgatagaaacattttaatgagggggtttggatcaaagtcataatataatgaaaataactactgacaaaaggaatctacaggttcagtgcaatccccatgaaaattccaactttaattttcatagaaatagagaaaacattaccaaaacacatatggaaccattgaaaaaccctgaatagccaatgcaatcatgagcaaaaagaacaaaactggaggtatcacattacctgatttcaaactatacaacaaagctagagtaattaaaacagaaaggtattcgccaaaaaaaaatagacacatcaaccaagggaacagagtagagcatccagaaataaacccatgcatatatgatcaactgatttttgacaaaggtgccaagaataagcaatgggtaaaggatagtctcattgaaaagtactattgggaaaactggatttccacatgtagaagaacaaaatttgaccttgcaccatataaaaaaccaactcaaaatgtactaaatactgaaacataaaaccagaaactctaaaattgccagaagaaaggataggagaaaagctacatgacattggtctgggaaatgatgttttggatttgatcccaaaagcacaggcaacaaaagcaaaaatagagaaatgggatttgatcaaactaaaagacttctgcattaccaaggaagcaattaacagtgtgtagagacaacttacagatcaagagaaaatatttgaaagctgtacctcagataaggagttaatatccaaaatacttaagaaactaaactcaacagcagtaaaacaaaaatcccaattaaaaatgggcaagggatctaaatagacatttctcaaaagatgacatacaaatggcctagaatatatgaaaattatcctcaatatcactaatcactagggaaatacaaattaaaacaatgaaatatcatctcaaacctgtcagaataacttttattaaaaagatgaaagataacaagtgttagcaaggatgtggagaaaagaaaacactcttgttagtgagaatgtaaattagtagagccactatagaaagcagaaaggcagttcctcgaaaaactggaaatacaattaccatgtgatccagaaatcccacttctgggtatttacccaaaagatttgaaatcagtttgttgaagacatgtctgcacccccatgtttattacagcactattcacaatagctaaactttagaatcaaactaagtatctatcaacagataaatggataaagaaaatgtatatatacagtatgaaatactattcggacttaaaaaagggaaattttattatttgtaacaacatgggtggaattggagaacattacactaagtgaaacaagtcaagcatagaaatacaagtactgcatgttctcacttggatgtcgaatctgaaacaattaaactcatagatgcaaagaggagaatggtggttacagagcttgtgtgttggggaatggggtgatgatggtcaaagggtaaaatctcagaccataagtgtgtgcttttttcttttttttgagttatactgcacagcacagtgaatatagttaataacagaatactgtacatttcaaaattcctaagatattaagttcatatgttcttaccacaaaaaagttaagatttgaggtgatggggatgttaactagcttgatttaattgtaccacatactatttgcaatattataacatcatcttatgcctcataaatgtatacaattataactgtcaatttataataaacttttataaatcaagaaaagaactattgagaaataattctaattggaaggattacatgtaagaagaatttctgaacaagagtctgcctttaaaagaaaacactgttgtttataagcatctggattagagtagtatcagaggcaatagaataactggatgtaaaatgatgacagaatgactatagatgatatatcaatgggtaactgttgtgaactgagtagtatcccctcaaattgatatgctgaagtcctaactccaaatacctgacaatgcatctgtatttggagataagatcttcaaagaaagaattaaaattatggtcattagttagagtgggccctaattcaacatgactggtgccctaaaaacaggaggaaattaggacataggcatatacagaggtgacagcatgtaaacacacagggaggagatggtcatctacaatgccaaggagagacacctcagaggaaaaaccaactctgctgccaccgtgaactcagacttcctgcctccagaactgtgagaaaataaatttctgttttaagccaccctgtctgtgatactttgttatggcagccctggcaatctaatacgatgataaaacactcagttttattttttgaagctttgcaaccttatacaataattgtgacatcactgacatagactggacaaatgaaagaaaaggtcacgtgggctttggcagatgatgaatctgtcaatacaaataaataattgttcttttcgggtcatttcaaatatcaagggtaggaaagcttgtcctcttggacctactagactatgggcaaagtgaggtcagagaccacttctttcttaattgttcactctatccgtgatgcctgaaatacagcattaaatacttaactatttgttaaatgaataaactcgtatttcccacggtgccaagtccagagtctcttgcattttgtcagcgtttcattaatgtttgctaaatcaatgggaaaaaaatgtcttaagctctaatctaagttgcaactattctgaaatgtcaatgatattaacataaatgagaaaatcattaatataaacagaaaattcatataaatattcagttacttcaactatttcttttttagaagattttattctcaatttaaattggaagtaaatatttccaatgactacgactgtttactacaaagacaagaaaaaaacaaacaaacaacaacataaaaaaacatacaatgacttcccatttcctccaaaaggaggcaagctcctctgcctaactgaaaattggttcacattttgcctcaagtttctactcccatctatagtttctgaatgtgatatatacatttcacaaacattggtcttctaaaacaatgttaaatcaatatcagttattatttgcctgattatcataggtgggaaagataaagtcttagtatgtcttccttccgcattagcctgaccattataaaaataaacgacatagtaaggaaagagaatggaggggaactttaatttctgaaatacatattacatgctaagtattttctcagtgacttaaattcccaaagcatctcagtaaaatatattagtagtctttctttcttttttttccacaagggaactaactagagcttaaatagactgaaatacctttccatggtgtcttagttccggcttctatgtcaaagtgccatagactgcgtgacttataaacagcagaaactcatgtctcatagttctaggagctggaaatctcagatcagtgtgtcagcatgtctggatctggtgcagggcctcttcaggcccagctccttgaggctccttttatgagggcactaatccagttcatgagggctccactctcaggtcctcatcacttcccaaagaccccacctcctaataccattacaacaagggttgggatttcaacatacacatttagggagacataaacagtccataacacaaggtaaaacatctgctgagatgcagatccaggatttggattcaaatcctacataatttaacttacaacatattgcctccaggattaatgtcattttatatgtaaatattaccaacaataatttaagaaacattatttctagaaacagaaaagttttcaattatctcttccaagtaagaactgatgctaccgcctaatccccagtgttccattgtgcactgagagcacgaggaagccagcctgtggcaactcactctgtttcaggtattttccctatatcaccctcctgctctgcaattccccaggttttctaagaaccaaaaaatgtatgcttctttttcatttcttgttaacaaagaacaagacactgtattaggatgcctttatcttacccacttatgctatcatctgccatagggctagcaacttgtaaaattcctcaatttccaccttgcttttaatagaaaatactgctctaaataacaccaactctcttctctccaagtattctatcttgaaacatttatccagcctagatgacctagaggagttgaacatcattagcagattatcatctgatataacattactaatagtattatatattaatattatataaaacacatatacatatacaaaaaataacattataatactattaggttcaggaaggcaaaattataaagggccttttgagccatgctaaagactttagatgctatccttaaaaagaccagtttgaaagtgagttgtaactatctgctagcaaaaagacaattgcatggacaaagataatgatagtaggaatgaaagggcaggttcctatttcagagacattgaggcacagactcttcatgatatgaaaactgcctggatgttgggggaaagggaaagggtcttccaaatcttgaccactttcatggaccaaatcctcctctgataagtacttgtttcctagctctattaattctattgcccaggctctccaataccctccatctatattctagggaccagatggactttttgctgtaaggacctatttctaaattcttcccatgtgtcctcatcattcctccctataccttgatttcaaggcaactcaaactttgaataatacgtatcacattcctagacaccactcagtatacacagtgatttttcttattgtgtatgggaaagagaaaatattctcagacattaacagttaaattatcatttgtaaatcagctagtgataagagaagatgcctttggcatcatatatattttgcctgctgttttaggtcctgccatcaagcatgtagtaatattttcaaacaattctatcaaataacagttgattatagaaaattcagtacaacttagaaatcttgccaataataataatgatagtaatattacctcttaatttttatgagaagggtcatgatttttgaaatgatagccaagtccaacttagacttacaaaatactttatatatgcatacatgcaaaaaaaaagtggctagaagaaaaattcagcaccacctcttcattatatgcaaatagaattagtaaatacgaatgtactacgtactagtaatatgcatgtatatatgtatgtaaatatgaatgtatgaccatgctgttttatagcctatgtactatctgtgcaaaagaggacagtggttatttgctcagactttagaactagataccttgagttcaaatcccagcctctacatgctaaataaaagaacccagactcataatgatggggctttagggataactcatatgatttaacatgtgcagcaggactaggtgagtccctggcaattagtaaacaatcacacaagttggatgtttttatggctccttttaatgattaacattaaaaataagtcatttatttgattttctgttttcctcctaccccatatctaatctatcagtaaatcctatcggtctcacttctaaatggcatgcggattctgatgaattcttaccacttacattgttaccactctcttagcttgggttcttccagaagcagagcctgagtcaagaaatcaagtggaagtatttatttgggagataatcccaggaaacaccaataggagggtgggcaagtgaaacaggaaacaaaataaagcatgtgttaaaaagtcatgctaaaaattctaggagccaatgtaggacacacacctcaaagctatcctaccccagtggtcaggcagttggtgcatgaagggggcatcattcatcgtttgaaggctgctcacagaggcactagttcttttaacacatcctcctccaatgttgtcatctcttttgcccccttacttagttagatatagccatattttatcagaatacagccaacataactgacactctcacttcttgcagttaactcaaaggtccctccacagacaggccatttctgataatcctatttaaaatagtgtctctccaaaaacaaaaaaaaacaaacaaaaacaaaaatgcataaaatgctagaaatctttgccatatatcaatatattcagcaaattctacgagtggattttagaaattaggatttagacaatgctatgatctatgcaatcattttaattttattcacctatgtaatgggggtaatgaaatttatactgggggctgtgagaattgaataaaataatacaaataaccactaacctattacccatttctaaaatatcataatttcaaaacattgtataaatagaatcataaagtatgtaaccttttagaatcagatttttccactcagtcttattgtctggataatcatctaagttgtcacgtatatcaataatttgttcctttttaatgctaactagtactaatatgatatatattatgacagtttgtttaaccattagtcagtgaagaacgtctatgctgtttatagtttttggctattacggataaagccactatatacagtcaaaaaaaaaagaaatataaagcactatataaatataatacaaatgtattattcttacattggacattttttatattttgccctaaagttttctgtgcaatttgttttatttcatttcccattttcctaaccagttacttttgttttgtttttacctccaaaactcctttaagtactttatgtgcctcatcatctctcagtgtttaatttggtgttgctctatttctccatgccttctctctaatgctgtttctagctccctccacatccccctcttggggtgcctgctccttcctctgagcactctgccagtgttgtctttcctgcagctcgaagctaacaagaccctgaactgctgcttctctaggacctcagagcttagtgttttgtcagcttcaagctgttttggagaaagtgttggcttatttctcagctgtagcattgacttagcaagtctttcttctaaacttgtaaataattcatttcaggtcaagttttgctaccagaaacttttcccagtaaataacaagtttctttatctccagtaagaaagtatggttttgtggtaatagtggtgagcaacttattaataaaagataagttctataataggaagggataagccttccactttggtacaactcttattttgctactattttttgatagggagcaaagtaaagaattatagtggtaacacaacttcctgccctttacaaagcccatcaataggaagtattatcaaaagctttgagagataagccaaacctcaaaaggatactaatactcctttgtcttgatttgtttcattccaggtcctctaataacttaaataattgaagaaatggaggtagttgaaacaacaaaaacataagcacgtaacaggcttctgagagcaagcttactgattttcatttgctggaaccacgccaaatgtgggctatggcgtctcaacaggatttccagtcacttcaaactgtcattgtctgagctgccccagtgactggattgagatcaggagtttcaagcattctgtttggccactgcaagccaaaaggagtgatggctgcaaggcataaaagggtacagactctctctgactagcaaaattgaaagcccagccagccacaatcaggctggcttaaagcatagtttattttctcttgtcaatctcagcaaaccctatttgttgttggcgtttcaacgagcaagacttattaagggtgaaatgtcaatcttgggccttgctctaccttgtcccaggtcagtaggcaaccaaagtggtcattctagcaagtagcattttgcaatcataagtgcttatgtgaacccaatctgagaaatgatttatgttgacaaaagagtaagagagcaaatgtataaagcaaaaaagagatggacaaaagagaaaaagtgcttcaaaggaactaagccagaggaatttcatatataaaaatatatatgaattaattttatatgctttactcaggaaaagacacacatacataccacaaaaatgtaagaataattgaaaatagagtcttcttgaaacatatttaggaatttgaacaaatgtctgttctttaaagttacgggagtgggtagagctttatgacactgtgtggggatatgggggatagaggagtcagagaaaccataacattaaacagatgcataaaaataatattagagtattttatggatgacacagttatagtttttaaaaatgatttttaaagacccctttgaaattgagatttgaattatacataaatatagccacaggacttctaaaattctataccaccgttcgattgtaatctaaaagggatgccaaaagtgcataagcagaagcccatgtaacttcttcacagtaaaaattactaatataacagggactgaaatgaaaagagctggcaatgcattttccccccagcatatcaagcaggttttcataaggaagctgtggtcatcaatcactacctcattaccagcccgtcatctgggcttaggctaaatgtattctggctggctgccatactaaatgttcaatgaaacatccttaaggctctctacaagttcagctgaagtcgcacatgctatacatcaaagaggaacattagcgttatcatagcttaataaatagtgccattccagcgatgtaatcctgtgttctagagctatctaccatccccagtattctactgcttaagtaaacaatctttctgtctcctgtgaggtttatttaatgataaatacatgtagagataattagtcatactactactgatatacaaatgtacttctaaacttgctgaaacctggacatgaatgagagtaacaaatattttaagacacacaatacatttacaaaatctgtcttggaatattaatcatacatgtacattgctattcatcaatgatattttgactctcattggaaaagttttaagccaaataatgaccccaatcttacttctgacttccccaagttcaactgattgaaatgttgtgcaaataagcaaccatttccttattgaaatggtcaacaaggacctcagttaaaacaatggtctcaggatttttaatatatttacaggtgtcactaccttcatttgtataaactatcctcagataaaaagactaaaagatgggttttttaaaagacgaaaattagacaaaattgttttagatcactcaacatttttacaattgctggtcaatcttagattggtctttagagcctaaagatagagccaacattcacattactaaataaaatgtccctggcttctctccaagtttcagaaacacacgtaatcttagcacaaaaaaaatggggcatacttttcaaactgtatcaaatttgcccaggccacatggctttctttagttttcctgctaatcacatgctattgattaaaagccaaaaaaataatatttgagagacctgaaaggtgaacctaaaatgtgaagtaaaccatgtttataagaattttgggtcaagataggatatgacaacaataagttatattcaataagaaagaaaaagacttagggtcaaatatgagataaagattattttggaccacgaaatgagacagaaatataaagtagcaagcaatcttaaggcccctataatgtaaagggaactaaaagcgtcatggggatctagaaccaggttttccctgaaagcctgggcctagggtagtattaagctgccaaagataagtggccaaaactgttgccaacacactgactgcaattttgactttattttaaaatgggaacctagagagagtgggagggcatagacacagcctcttcactattaatcaaaccaaatcatcaacgattttagacatcactgtgggaagaagccccacaacacattattaagatgttgggaaaaaaaaccaaaaaacttttcttgtatcctcataggttctgtcaagggggcctgcaaattaaactaacaaaagctaggtaagagaaaaggtctaaaatttttattaatatttacatggataggaattcacagaaaacaagtgaaattcaagtggttagattcaggggcttatatgccttttaaaagggggcattaggcttcaagggatgattaactcatggggaagtggctagacaatatatgggggaattaatggaatagtcgggttatattagtaaggtttattcgtgcaaactcgtttcagcgttgactccccatttgcagtgataagagttgttcttcctttcttggtgccaggctagggagggagagccttcacaaaggaaaatttatgccctgcttttagacagataaggggaaagaagataactcttcctgcatcttctgcttctcaactgggcttcagctcgaaaatcatccttatgccaaagtagaatattttgcagtagattctcattgaagacctgataagaactagagtcctgaaggaacaggtgaagaaactgctaaaccactaaataggaaggacagtttatagatgaggagagagaagaaagtaaagccaacatgaatttacaaattcctattaaaaataagcctgaaaacccaaactcaaatcctgtaaaagattctaatgctaagaacaaaaaccaagtaagtcaataagtgaatcatgaattcacagaatttaaattaattttaaggaacaccaacaaaaactttgaaataagtatgtcaatgcttaaaatggaaactgacacactggcttttatcaaaatgaagcatcaatttatgacacaaaaagaaaaataattaaatataaaacaacagatttgaagaaaataactaatacataacaatagaaaacatatataatcatcaaaataaaaataactaaaaagataattcttactctgaagatgtcaaagcagtaattagtgatgataccaagaaattcatccacaaggtagaggaaaaagccatgaataagtaggtggaagatacaaaatataacaacagatgtcttataagcaccaaagaataaaatagaaagagaaacactatttgaaaaaattgtaggtgagcattgtgcagtatttgacactggtggccacagtaggcatacacgtttctgcaaggcatatagaatagcatcagaacaaagcctattcactgtctggatatagtaaaactgacaatatcaggagttttagggacaaagagaagcccctcaggaccaaatctaatcttatccatctagttgcaattgcttgaaattcctttaactagagacaaagcctttcaatctatagctagagataaagggcttaaaatgcaaataaccagggagaaaaaaaatgtgttcagtccatgttctgtttacttaaatggagtgttgaaaacagtgaggagacacagaggtgccattgagagtgatgcctctgaagagaaacgctggagtggcactgcctcaggcccaggctagcttgatccttggctccagagtttaaaaggcactgaccatagaggacactgctcttctttggctgtaccttaggataaggaattatgtagggaccgatatatatgcccacctcaagcccgcaccttccttcctcccatttaattgtgggaattccattcccaaaaggctgaacctgtttccagggcctttgtgaggcacagtctattccttagtgttccatccctagagtgacgtgtctacataccaagagctaggggtggccagggtgcagttcttgggatgggagaggaatgtactgcctacttctccctcagtggctccgccatgggattatgtgttaacgatgtaattggcacccacagtttaagaccaccagtgtggttcttgcctaaataatgaatttacttacaaattgcactgaaattattctctagctattaaatacatggatgcatttcttaatcaactagcatggaattcttcaagggcagggaatacgtctgctaaaattattcaactatcctcagtgtctatattgtacatgtagagtgtattcaaaaattaatgtcaaacaatttaaaaggaaagatactgacattctcattaactcaactcattatgtctaaagttgaagaaattgtcccgtcccaaaaactagatatttttctgttcctcataattgtttttatttgtttgcttctttgtttttgagacaggatcttactctgttgccctggctggaatgcagtggtgtgatcacggctcactgcagccttgagttcctaggcccaagcaatcttcccacctcagcctccccagtacctgggactataggcatgcatcaccatgcccagctaagttttgtattttattgtagagatggggtttcgccatattgctcaggctggtctcgaactcctggactcaagctatccacccaccttggcctcccaaagtgctgggattacaggcatgagccactgcacccagccatagtccctcataatttctattaaaaaaaaatcactaagccaggctcacttagcatcatttttggcttcattcccatctctcactccaagcatatagtagttactaagtcaatcatccaagtaataatatcaaagtaataataccaattaatgaagtcatactgttgatcctatttcatccctttttcccactttcatttccatttcaactggccccacctttctctaggtctctatttcttactcctagattacaatcatcacatctgagtcctaccgcttacagctgtgttaccctgggcaagtcacccgacctttccaatttcatgatctttataaataaaatatagataaaaatccaccaaatagaattgtgcaaaattaagtatgatttatttatgtttcttagtgcctgacaagaacacttttaggattacttgcatttgccatttttatatgaaagaggacatgggcaaatgaagacatataatatgtgaattatcatttttataattattatttaaaatcatcattaataacaaacttttgcttccccacttctctgagatcaacacagctttacaatgttattttctaccgaagagtcttgaatgcttccccagtaatgtctgaattctttaatctctgtaacaagtgaaaagttcttattcatattatcttaacactagaaatgagaagttcactcagtgaatgagggcattgtctctcccatgaaatgccttgacaaacctacccagggtcagtaagaaatcctgtgagcatggatggcaggcatacaatgttgcaaaatgccagggaccttgattcactgtgtgggaacccactcaggtccccagagttggtataagaaattaaattgaaggtatttgagattcaaccaatgcagaaaaaaacattgttggagctttcccaatttgactaaaagcagaaacttctgggaaatgaggctgccataaattccatcttctgggtggcttctactcccaggaagaagactaagagtacagctaccataaatcctctcttcaggagagtttcatggcatgaagaagaaggaaaaaccacacacacctcataaatgaacattatcacaaactttatctcccatttgttctcctcaaaaccaatttgtctttcctaaagaaacctacttgttattcccatagaagccttcccccactcccctactaagttgggtatattaggctttaactttaaccatttatccagctacctacttcttttgttagctcctttatgcatatgaataaaccttttttccttctgataatatcttttggcagtttattttatagaccccccagacactgaacataagagagtacaggaaaagttttccccccctcaacaacacaaaataccctaaggttggcaagcacccagaaaaccaggcaaaggactaaagagctttgccttagaccaggagacatatatattattttgctccaagacaaacaagaaagaagtgagaaaagagaaagggcagaaagaagacaacaaaggaaataggtgagatgtaatttcacgaagggaacaagtgtgatagccaacgaatattttaagaacagtgatgcctactctgctttctaattaatatttttattactttactatacatctcttttccaattcctttaaaatatttcaggaaaatactaaccttactgatggattttgtgcaaatctatactaaggatcattctgaaaggatggaatagagaacagataaaccaagaccttttgttgacaaggtctcttttgcttgaagggtgcgctaaatgcaatacgttgtgcccagcatcatttctctgaatttgcctgatgagcccttggtgttcactctaagcacatgtactgtatctcatgtaacattaaatattaatggtgttctcataaaacttgctctcttccttggccttgacaagtctagaacttgtgtttccaatttgttgagaccaaggaagagaacaagttttcatctggaaggcagaaggttttacagatgagaatcacatgcataacattttcaaaatgtacatacagtgagggtaaaaaccctcactgtcagctcagcataccaggatttggtcaagagaggcacacagacatatgtacattggcacatcccctgaagttatgctctcatttatttccacagagaactatgccctgggaagccatgcctgacagaataagacacagatgtttttgcacatgtgggtacttgtggcaaatcattatgtcacctaggagaagctactttctaaattaatggccatcaacaagcttaccaactctttattattgatcatatagactaagccattatgaaaattcaagaattaagttgaaagctcctggtattgagtgagagaaaatcttcatattggatgacttagtccattttgcattgctataaaggagtacctgagactgtgtaatttataaagaaaagaagtttatttgccaatgcaggctgtactaacatggcactcatatctgtttggcttctagtgaggcctcagtagacttacaatcgtggcagaagggagggggagctggtatgtcacacggtgagagagagagcaagagagaaaggaggaagtgtcgggctcttcttaaaaaccaggtctcatgtgaacttacagggtgagaactcactcaatgcaaggacaatgccaagctattcatgagggatctagtcccatgattcaaacacctcccactaagccccaactctaacaatgaggaccacatttcaacataagatttggatgggataaacatccaaaccatatcatttggagatggtatcataacggtttcaatatatatttttgaagctttaaaaacatatttttagccacagaacagtcctgcattgttacccatcagcagtgtagtaaggcaaatcttctttgtaggcagttgatgaggcagaagatatacagacactgggttgcattcaaccagcactacccatttgctaactgtaaggcacacagttttaaataatcttggtgtctctatatacaaaacagaaataagactattctcaggattgcaataatgacttaaaaatacattatagatgattggtatatatatgtaaacagttaataaattctattgcttactgttattgataatgccattattacaaaatatgtgtgtgtactaaattaaaaataatattctattaccttttgttttctaccgctccatggctcagacactgaaaaaaattattgtactctattcactattaactgttattttgtgtgtgtattttcagttgctttccttcatcttatatttttcttacttatataaattttggaaaaaaaatgtaagcactatgcatttttaaaagtataaataagagtttaatttactagaggtttttaaaaatctccttcctagtgataattaaggtgatgtgctatatcaaataatcaatggtctcattaaaaacaagaccccaatcttataaatagtctatgaagctgggtccttcagcgttataagggtgtgtgtatgtgaacttaatttcatataattggtaggtaaacaaagaaataagattttcagataaaacattgattccaattatctcattgttaattcaagaaactactatggaggctttaataccaatttttttaaaatacatggtcaaattagatcctcaaacgcatgtgtatgaacagatgacgcagaacatgcctattcaagacaacatggtttctgagtgacactgattaacaatcttgtgaaagctggcctttattctactcaacttaactgaaacaatggggcagaaatggtgtttttgccatatcacaaatatgaagttaattttcaaaacaaaagcaacccaaagttaatcagacatcagaaaatctatctgtctagtcttcatatataactgacaactcattaaaatgtttaaatacatactaatgaagtcaagttacgtagtgacttacagatttaaagggtacaaattcttcgatttgtttttaagaaaaaacttctaagaaaatggcattttccaaatccaattgttgcatttaagatttttttttattattgcttccagcttcttgtagaagcatttttacttacaaatttcttttattttcttttatttttatttattttttatttttgacggagtctctctctcaggctggagtgcaatggcaccatctcagctcactgcaaactccgcctcccaggttcaagcagttctcctgcctcagcctcctgcgtaactgggattagaggcacttgctaccatgaccagctaatttttgtatttttagtagaggtggggtttcaccatgttggtcaggctggtctcaaactcctgacttgaggtgatcctcccactgaagcctcccacagtgctgggattataggtgtgagccactgtgcccggcaatttatttactttctgttagattattagagtctgtaattgtaagttatgtaaccacaccatgaattaacaggcttgagggctttccctgaaagatgggcaaaaggtgggacagagcctgagttttccacaactgctactgccatgaagttcctgcccctttacacaagtggtccctcataaaaatttcccctgggtgaaaaaaaatggtcacttcaatagaaaagtcacagaggccaaaacagtgatagaagaaaagcatgactcatacttggccctgttgcttgaggcaccaagatatgacatttagtataagtaatttgtttattcttgcctgctatgattttaatgggtgggccttctagcataaaattcttctagcataaacttttcctcttcaatttgaaaagggagccataggctcccagtttttcttagatgaaggatatgactacctgtctggcacatggatggagtgtaaaagctatatggcactgctgagactgtcctcaggcttgcatgggggaacataccaaatgatcatttctttatacacagttgattagatgggggatgaacgcctaatctagttcctgatttctgacaaatccacccagatattgtacacagtgcgtagtgggcaatttggctgaaatctggtgcaaagtacaggactgagaacttcttttggagacatatataatgagcacatataaaggtgcagaggaaaggaaggggatggagatagaagaaacaaaaagtgacagatcagatataaaagactttctaaccaccaaataaagaaagattttacttctactcctgatattttccagttccgctttcatttcctacataatccatcacataaacagaaccaatgacaaaaagccacatgattatctcaatagatgcagaaagggctttcgataaaattcaacaccacttcatgctaaaaactctcaataacctaggtattgatggaacgtatctcaaaataataagagcagtttatgataaacctacagtcaatatcacactgaatgggcaaaagctggaaccattccctttgaaaaccagtagaagacaaggatgccctctctcaccactcctattcaacacagtattggaagttctggccagggcaatcaggcaagagaaagaaataaagggtattcaattaggaaaagaggaagtcaaattgtccctgtttgcagatgacatgattgtatatttagaaaaccccatcgtctcagcccaaaatctccttaagctgataagcaaattcagcaaagtctcaggatacaaaaatcaatgtgcaaaaatcacaagcattcttatacaccaataacagacaaaccaagagacaaatcatgagtgaactctcattcacaactgctacaaagagaataaaatacctaggaatacaaattacaaggggtgtgaaggacctcctcaaggagaactataaaccactgctcaaggaaatgagaggacacaatcaaatggaaaaacattccatgctcatggagaggaagaatcaatatggtgaaaatggccatagagcccaaagtttacagattcagtgcgatcctcatcaagctaccattgactttcttcatagaaaaaaaaattgttaaatttcatatggaactaaaaaagagtaagtatagccaagaaaacattaagcatgaagaacaaagctggaggcatcatgctacctgacttcaaactatactacagggctacagtaaccaaaacagcatggtactggtaccaacacagatatatagaccaatggaacagaacagaggcctcagaaataatgccacacatctacaaccatctgatctttgacaaacctgacaaaaacaagaaatggggaaaggattccttatttaataaatgttgttgggaaaactggctagccatatgcagaaaactgaaactggattccttccttacaccttttacaaaaattagctcaagatggaaatcatcattctcagtaaactatcgcaagaacaaaaaaccaaacaccgcatgttctcactcataggtgggaattgaacaatgagaacacatggacacaggaaggggaacatcacactctggggactgttgtggggtggggggaggggggagggatagctttaggagatatacctaatgctaaatgacgagttaatggctgcagcacaccagcatggcacatgtatacatatgtaactaacctgcacattgtgcacatgtaccctaaaacttgaagtataataataataaaattaaattaaattaaattaaattaaattaagttacattaaatttaaaagatggattaaagaccgaaatataaaatctaaaaccataaaaaccctagaagaaaacctaggcaataccattcaggacataggcatggacaaagacttcatgactaaaacaccaaaagcaatggcaacaaaacccaaaattgacaaatgggatctaattaaactaaagaacttctgcacagcaaaagaaactatcaccaatgaacaggtgacctacagaataggagaatttttttgtaatctatccatctgacaaagggctaatatccagaaactacaaggaacttaaacaaatttataagaaataagcaaacaaccccatcaaaaagtgggcaaaggataagaacagacacttctcaaaagaagacatttatgtggctaacaagcatatgaaaaaaagctcatcatccctggtcattacagtaatataaatcaaaatcacaatgagatactatctcatgccagttagaatggcaatcattaaaaagtcaggaaacaacagattctggagaggatgtggagaaataggaacacttttacactgttggtgggaatgtaaattagttcaaccattgtggatgacagtgtgacaattcctcaagtatcaagaactggaaataccatttgacccagcaatcccattactgggtatatacccaaaggatgataaatcattctactatagacacatgcacatgtatatttattgtggcactgtttacaatagcaaagacttgaaaccaacccaaatggccatcaatgatagactggataaagaaaatgtggcacatatacaccatggaatactatgcagccataaaaaaggatgagttcatgtcctttgcagggacatggatgaagctggaaaccatcattctcagcaaactaacacagtaacagaaaaccgaacactgcatgttctcactcataagtgggagttgaacaatgagaacacatggacgcagggaggggaacatcacacaccagggcctgtcaggggttggggggctaggggagggatagcattaggagaaatacctaatgtagatgagggattgatgggttcagcaaaccaccatggcacgtgtgtacctatgtaacaaacctgcacgttctgcacatgcaacctagaacttaaagtataataaaaaaaagaaaattgtatttttaaaatctgaaaaaaaaagaatcatcctttatttgagctcactgcaatggttttctacacagaagtcttctactgagaaccacagaaaacatctgtattgaatgctatgtctgtatatgggggaacttggaaaagaaaatttcaagcttttcaatctccaatgattaataaaaataaaactgtaattttatatatctaccaaaagatcatgttaaaaattcttgccatcgctttctgacccttggtttcaggtaactatatgttgcaaataatttgagtatatacatcagatggtaatacattataaagtgaattttccatttttgtttgtttgtttgttttgagacagagtctccatctattgccctgtctgaagtgcagtgtcacaatcttggctcactgcaacctccgcctcttggattccagagattctcctgcctcagcctcccaagtagctgggactccaggcgagcaccaccacacacagctagcttgttttttgttttttgtttttgttttttttttttgtatttttagtagaaacagggtatcaccacattggccaggctggtctcaaactcctgacctcatgatctgcccacctcagcctcccaaagtgctgggattacaggcatgagccaccgcacctggccaattttacatgtttttaatgtcaaatatttcacacatacattctggaataattaatatattcacatatgcaaagataagatataaaaatatacaccatgaaaagtgacccttcactgttgtctcctctatcttaagttttcttgggtagccttgtgtctataattttttaatgcatacacaagaaaaattttacttttttatgcaaattataatatatatggttttacatcaactttcttcccagtactgttccatcttagagatatttccccatcagtatttaaagatctttaatatttttaaaacttacagtattctattgcatgaatacgctgtaacttatttatcagttactacctagtttttcttgatggacatttaggttgtttccattactttgctattataaacagtagtgcagttaataagcttttagacacattgtttcatgtatgtaatttccaagaggtggaattgatggttttatataataattgtataggagtgtctatttccttgtaccctcgtcaacaatttgtcagtgtgatagataaaatggtaggtcagggagtgttgagttacacttcttttattatgtgtgaagttgagcatctcttcaaaagtttagaagtcattttaatttccttttttgtgaaatatattattttatcttagtgaatggatccaactccattacagaggatatcccagttatatcaatgccatgtaagaaataacttgtcttttctacactgatttcaaatgctactttttaaatattctaaatctctgtatgcatttgtgtctgtttctgtttttttaatctgttctgttaatatatgttttcatgatctaatgctatattattttaattcatgaggcttaatgatatgttaggtttataacaaaataatttaacttttgttgttcttataaatatggtctttccttactacatcttctgatgggttactgtttgcatatataaaagctgttgatctgtgtacaataattttgagccccaatcttactaaagtttttctctaacagtttcaccaagaacagtctccaaaaaacaatctttcctgagttctgagaaattacttgtagattctatatttgaagaaaatcttagctgaatatcaaatacttggctcacactttatttctctaaatatcttgtaagtttggtttcagtgttttctgttacagaatgatgctgtgaggagtgtaaagccagtctaatattttctcttcagtatgacttgatcattttccctatatgtccaaggaagttttattttgtaaaatacaaaagttttcctaggatatttctgtctaaagcatcccagggcaagtcttttcaaagtacaatttcaaacatttcatttcacacaaaaatattttttgtattatagtttcaaatacatattctgttccagtgcagtgcagaatcctcctgaagtactccaattatgcatatgttgaatctgctttgattgtttcctttggttattattttctctccctattctttacttttatctgtatcttctttttattttttttttcattttcctcctttccatatcagatgtcctctacagggctttgctatctttattcattcttatgctcctcccattgtgtctttattttagtgattatgttgtttgaacgcacatcttcttttatattttgtcaactcactttctatttcctattttttcttattttgttctgaggcttatgctttatggttttcaaaacactcatggtaatacaagattaagttttcttcttttaaataaaattcaaaatgttttgttattttctttatgttccattgcaattttttttggaaagtatgcttatctcttggtaaattaattgcctcttttccataaattttctgtagtatttttcttttaatgccatgagaatatcttattactcatcatgtaatgagctaactttgcttaattggttatttgcaggatgttcctgcagaggtggttatggtgagggacagagttctctcctttcttgctgccacagggataggacactacttgcaaatatggcttatttgtactggattacttgagtagtttcacctactctgtttttctgaacaaaatcaagttcagaaagctcttggttgctgttgtttcttcccctcaccagcattgctcatctcagttcccatacccatccatttaaagaagaacaaagtgcccttgtatctgataccattcctgggtttcccaagactctaaaatacttatttgcactttctcacctgtagttattgcctgatttcatcagctctggaagctcctaaattacatcagaatataccacttgtatttgttttctgatttcctaaaaaaatgcattttttgatatggctgttgactttaaggagaaatgggaactagcttactagaaaatataagtttaaatattttggtgtcctttccaccaataaaaatttaaatacacatatattcttaaattttaacatttatacattttcttataagtaatcttatatttggtggcccaaagtgatggggagatgagtacagagccaaatgtctatctgattagaaatgaaagataaattctcttgggttgaaataacatgtaggagatcatgaagaaaacaataataagaacaataacagaaccagtataatatacagtttttattctaatgtaataaatatttatccagcgtgagtgttttactaaaagcagacaactttaaatccaaaatcacatatgtttttgaagggaaatatatatacaatgtataataaaataatattgagcataatttcattcaaaaatattttatctttataatttctctgaatgagctaaaaagattatctctaattactgacttgttatcaaaccatattatatctgcatagtatctttgtataattgtataacttctgagaaaacagatatataaaattacttcatatttgaagtttttcctaataaaatattaagatcactaaactgtcaaggctgtatgataaccaaaattatgtccaaaaaggagctactaaaataaaaagttactaactgcagagtctcttctagtttttcccaactcatacatctgatattttgccaattactgatgactcaactctgccctttctctctcatccatcttcttaaattcattcctgctgctactaccaaatcagattttcattaactttcaccttggctacagccttacagaaacacagaaagttattattgaaaggaaccttgtagtcataataagcctactgaatgtcaagtctggatttaagtgcaagcattattaggtgatagtttgagtcaattgtcatagttttggtctggcaatcagaaaaccatactgatagcctcactataatcatggtaaggaatctagatagtgagactaaatatggattcaatcaagcagtcatcatctagaacatctaaccttagaaagtatgactatggaaatcactctggggcttagagtaaatgtctaagacattataagcaaactgacttaaaactaaggtaaaagtggacccagtcaggtagaccgtgttacttacaggcaatttggtgtttgtggatcatctcaatagatactatgtcatgtgtttgataggaagctaaatacttggggaataaacctggatttcctgttatatgattatggttaaaattagtattttgacaatgaggtttagaaatagttactaaaagaaaacactttattaaaaaaaaagagaaatcaagtaaaagtggaatcagaactaggaaagacactgatttctcctataaagacacgcagttttattcactattgaaaggtaagaatacattataataatagctaacacatgttaagcatttgttttatgccaggcattattctaagcattttcgctgtgtgaaatcatttaatcctctcagtcctgtgaggcaaattatatgattattcataattaactttaaaaaaatagaacaaagaattgttaagtaactttttaatcataatcacttggaatggaagactcttagaaactatgtataagcatacggctactgttacctcatttcagtcagagaagattccccttagaagatcctctatagaccctcagtgtcctatattgaatctaaattcgtattatatttgtagtaagtacacccagatcttaattttgttttacatatgttatatctacataattagtaagaagaacaaatctctatatgtcctttgatgttaagcatgttaggctacattaatatttaacatctaagcaaggagctctaaaaaactcctaaatcaagaaggtttatattttcctatgtttgcctacatattgcagtgtaattgaggaagcaatttttagtctttaattaattggaactgtaattattcagcctagagaagtaaatactaaaaatcaatttaataaagattttcagctacataaggagctctcaaggtgatcatgactatttccatttaaaaactggatttatctgatagcacaaaagatgagtgaaatattcctgacagtgagggttagcaaattttagaaaataaaaaggttgtagaaattctttttataaatgcgtttttaaatcttgttcatatttatcatcctacttatgatactatctgtacatgaataagttacttaaaatatgtttctttttctatcttgaatgattttgtggttggaaataacaattagtttgcttaaatctgctcatactacaattaatcatgtatttctctttgataataaaataatattttttcttcacattttagtgaagtcaaaacttggaaaacataaaatcttactggaactgtgttattgtcagaagaataccactgtgtttaacttaaatgataattaagactcgcatatttgaaagtttaatataagaaagggaagtaggaagttccaaaaagtaatgatgaaagacactcttatttttaagccatgaccattcctggaagaaaacagaaactgggacacaggcgaaacactgaggttccatagttggcaaagatttgtatgcctggatagattagaattcaatgtattacctcctgttcttattaacagccccccttgctatagcctcttaaaaggtttcccaactctactctgccatccaccgaggccgacagagtaattctttttccaaatgcaaatctgatcatttcacttcccaacctagctatctaccatctcctgccactgcttcttttctttgttctctcaaaactcagcttgcaggatccctcctccctccacttaggggatgttcccttagaatgcaccctcatagccccttacatttctgcttttcaaagtgtttcattatgtgatgtgttgtactgaatgtctgtctcccaaaggctaggagctcctctagaacaaggactctatcctctttactgtcatatttcaagtgcagctctttccctggcatagaacaggttctccattactccagtagaaaaaggagcaaaactgctaagaacaatgtttcctcttctaatcttgtaatgtattcaatcattcaacaaaacatttagtgaagatttagttttatgctaagacctaaggcaacaatggtcaaaagagatacctaaaccttgctccaattcagtttctaagttattaacaattacgcacacaatttgaaattttcaaattttaaaaaagacatgtttttcccatagattttagtttatgatggtgattatattttcctaaattctgttgatctggagaggagcttgctcataattacaacacccaacttcacaaaagggcattttagaggcaagttaaacaaacagatagaaacatctcataaaccacaaaagaaggaattagtagtccctagggcataactctaatatagattattccaagtttattttcacattctttatcattcctattatgaatattatcagtttacttgttccttgaaaaaaatttaaatcttatctgtttccacagtgaataattcaaggtgtgtatacacacacacacacacacacaggagagcttaaatattagtacttaagatagtaccattcccttcattatattctattatttgtcatataacatgtcacctaactaaaaattgttcaatcataaaatgatagattattcaaatgtctagccacaatagctgcagtgaaaagccttagctctgagtatttgatgagtgttcaattaagacctcaaaccttgtttctctttgggcaccgttattttaagtagctataatttattcatctttatacataaaacatgtacaattttaatagttgtatatgatacaaaatttgaacatttaaggatatgttacaccacattaagtttaacccacatttatgtcttggatgatagatgcaagaattccaactgaggcgattttatgaaccagctaaatgatttgtattcagaacagcattaaaaatccccatgacaaagtgtacttgaacaaaaataccctgcttgtgacacatcctttacaagtaatgtgttttcatttttcacatgttgcatctcatttattttattcaggcacacatacctaaatcggcaagatactgcaagcttccaatacctttgaaataataaatcacttcttgcagatgttttcacccgctgcaaggctgccgttcattaatcaaacattatcattttctatcagtgcccagtgttaaacagaaaaggcacttcattttgagttctgactttcatctttcattcactggttacaccctgaccccacaaaacttactgcttccattctggaaatgtgaaacctcctacagcgtaatagattttgcagcaaaaaatcctaaatggtattatattttctgaattcaatatgctttatcaggagctaaatcaaaccagattttaaaaatgccaaataaatgcagtcataataggcatttaaaattaggtacacaataataataaatttataacataagctctttttctatgaatatatttaatatctaacacatcaaattgctagaacaaagattcagagatatattttttaatttagcttaagctattaaaatcatttcagaagccaaagaaaggcaatttatctacctactataatttttaagcccacaaaaagaaaatggaacaaagtgagagacaactgtaaaatctttctcatttttttttattctctaagtaaataaataatagagaatgatcaatttataatacaagaaatcaagatgatcttacggatcatgagtcactatattcattctataaatagtcatataacctaaaaaaaggacaactgatttaatctagattgctttactgccttaaaaacagctcaagagtacagatgctgcaaaagagaattttagaaatcactttcattttctcttaaaaaattctcatgttattcatcctctttgactaacatctcctaacctataagaacataaagctaacattcacttaaaatctgacctgataatgaattcataaactagaaatggccacgcaattgaataaaaaggaaatagtttataaatattctgtttcatcattatgaattggtatcattactgattattcacaatctgtctcccattaaggtatagtgctaataactttacacatggatatggcccccttcccagtaaatttataataaacattatgtgaatttgtgcaggagaattttccagaaaaagatctgaagaattcagagtaaataagaaaagctaaaagcaaagcatattatcaagatttcattcaggtctcaacaaaacccacataattttaatttgagggcggaagggtgagggacatttctattgcagtattttatatggtgaagatcctgagcatggtaggcctaaggcagtttcctatgatatcaatcaagaaactcagatgctttttcactgtctctaggataaatctaaactctgtaaacttcttaacctcgggtatatgacccataattgtttatttgtctcctaccctcatgtcctatctactgttatttactctctgcctccctcagcatgcttcctaggcatatgccatcccataagtatcacagttttccaaatcgccctcttctttcaagtctccgtgttatggtggacaccactttatctgccagtgatgatcctgcttcaatttttctatctaacatactcccacccctccagattaaagactcaaccccctagatggtcatttatctatcttctctgtcctccctttgtacgtcactacaataatatttttccccttaaacacctatgagcatctctgggaagagagtatgcctaaattctttaccgaaggacaagtatagtgcatggacaaataatacctttcaaaaatctgacaaatcattaaatgaaagaatggaatcaggtaaaagtggcctttcatagtcagaatttcagtttgtttctttctcctttttttttttttttttattttgagacagtctttctctgttgccaggctggagtgcagtggtgccatctcagctcactgcaacctccgactcccgggttcaagcgattctcctgcctcagcctcccgagtagctgggattacaggcacgtgccaacacgtccagctcatttttgtatttttagtagagacagggtttcaccatgttggccaggatggtctctgtctcctgacctcgtgatctgcccgcctcggcctcccaaagtgctgggattacaggtgtgagacaccacgcccagccaaaatgtcaatttcttagttgtcttatattctgttgtctttgtattctcatgataatttttcttgtctttttatattttcatgagaccagtgtcccccttttccttctcttctattctccctaccttctcctctcacctttttatagggaagggtctgcaatatttttgtactaagtgttaaatgagtaataacgataaaattctatccttccagacacacatacataaacacacacacacatttaacaaaggataaacataaggtatggtccttatacgaaataataaggctttaattatgaaactgtgagtatagactgaagagtgatggagaaaaatcagaatcagatctctgttgaagtctgaactttgtatctagcagtgatcaatattgtgcgtgtgctctccatacatgtgcacaataacttatcaaggtgtctctacagtttataacccccaccttatcttagccaacccaacaatctcaaaaattaacgagttaagtaaagatgccattcacagaattgcacagggccaaatagattacagaatatgtagctataaatatacactgtcctgcttccataacgcatttgaaataatctaatatgatggatagataattacaatgattgagcactgaaattaaccctgagattttttgcattgaagtaaaatgaaattattagaaatcaatatctgatgaaagaaagcttactgactcattaggagccaaactattttcctatcactaaattctttaaggaattctatgacatcagccaatatataaagatttactgaccaatataatataatttttatagtgatttcacaaaagatacaagatttcattatgggaccctttaatattcataaaagttcagggagttataataaagtaatatatatttccatatattttcacgattatgtgaggtattctattgtatataatctttctgtatagaatctccaatacatattatttgacataagcagcaaaagcataccaatagaaagaataatttgatcactacattgttctatttgtcagaaatgtcctttataaaaataaagacatactattaaatggtaaataataattaaaaataacgtgaaaatagtcaataaaaatgactatggtattagtctgctttcatgctgccgataaacatatacctgagactgggtaatttataaagaaaaatggaatcgcagttccatgtggactgagctcgcagttccatgtggctggggaggcctcacaatcagcagcagatgaaaagtatgtcttacatggtggtggcaagagagaatgagaacaaagagaaaagggtttcccttataaaaccatcagatcttgtgagacttattcataaccacaagaacagtatggggaaaccgcctccatgattcaattatctcccaccccgtccctctcacaacatgtaggaattatgggaactacaattcaagatgaggtttgggtgaggacacagccaaaccatatcagctaccacaacagaaatagttttctaactgttgtgacctacttgaatatacacaagcatacttgacccttgcatttcctaagaaaaaaactttggcaattaatttagtgaagaggaattctgaaaatgaacaaaatcctctgggatcccacaatgaagtgtcatggatctgatttttaaaattactgcacagctcacacaaaagtatgtacatctttttccttagaggctaagacatggtctcttgaagcttagctctcctactctgttaagcctcaaatagagcgagacacatttgtgactgctgtttcagctctcagaagatgctttttgcaagttccttccactgctgcctgctgaaatacatccagcttcccagatccaaagtaatagaagtaatttcctatggagttaaatttgttttgttttgctttgcttttgcttaaacaagttgatttctaaaattcagcttggacaaggaaattaaaattttggtgacaacaataaaagttaaaatacttaaaaacagtctttttatagcagaagcaatcaaattagaataacaagcataggaatacacaaagcactgctgcagaagactctgcctccaccccgccccaaccaagggaaacaaaaactttaaaaactgtacacatttgatataaatttgaatgaactcatgttagcttgtgttgtgagccagttaacagaaatattgacgttaaaggttctttttgagtcatttagctttcactgttttgggagaaatcaggatgaaaagggttagcatgcctaggaaactaaaaagaaggacacactttactttttactttttaataatataactgctaaagaacatcattatttattacgtagaaataaaggcttagaagacaagagtgacttttcaaaatacctacatttcctgagctctaattttgtcatatttccatttttatttgtaaatctaaatgtaccattttccagtaactagcaatcttataattcacaacaacacatcttatgcaacaaataaccaagccaaactgtcatattctacctacggagcagttgttctggcagcccagcaagaagaaggagaataatgttctccacttgtagcatgcagaaattcactaatccccttcttttcacggaagatctttctgtcttgtgtcctctggtctagacattgggtttatcctctttactgaacaacagaattctcaagctactcaagatgaatgagggaatcaaggggtctagctactttttttaatacactcttcataaattccctattttttggccttgtcttcactcttatttccacagctacctggtactaccaatcttgaaaccttaagtaggttcagtagtacacattatgatacttctccagtctggttaaggatttagctttcttgggtctgctaagtccaacctcatgtagccatctgcttttcaacttccaaaatgttgtcatttctgctcctttctattctttttttccttctgggcttatgatttttgacaaatcctgttgctttcatttttgtgacaatccaggacaggatatagagatacacttgcatttggtctgccatttttaaatgaaatcctcattaaactaattttataaagaagaatttccatcgataaattgtatcatactttgtctcaatgcttaggaattttttatttttttttttttcaaaagactgactggatctatgagatctatttccaggtgtgactttgcttactataaatggtcaatattccaagaatgaacttgggcttgattcaaaactcaactgcaatttcttaactctgctgcatgattgtattttttttttttttttttttggatgcagtttcactttgtagcccaggctggagtgcagcagcatgatctcagctcaccacaacctctatctaccaggttcaagcgattctcctgccttagcctccacagtagctgggattacaggtgcaagccactgcacccagctaatattttgtatttttagtagagatggggtttcaccacgttggccaggctcgccttgaactctcaacctcaggtaatccacccacctcggcctcctaaagtgctaggattacaggcatgagccactgtgcccagcctgtattctttaggaccttcactgttcaattagcctgccagtaagcaaggattagggaaaacaaaatgagttatgactttctgtagatatttattcactaaaaattataaagaatattaaaatttgtatttttaaattaaatttccaaattctaaaacatgcagtcttgcccatcagctgcctcactcttatgacttataaagttgtcaatattttttatgggcaaatgtaatataaagcaaattattttttgacattgttgaatgatctcctctcaatcagtgaaaacacattctcttgccattactgactaagcaactggttttatttttaatacattgtgtgtaaatgaacaaccatccatcttcttgtagtcataaatatatctgataaaagatgattccctaacaaaggaaccacgggcgtctagaaataacagtttatgctgcaatttttatcttaataacggtatcagaaaactgataattcaacatcaataacgtgttccaattagaaatatatttattatataactagcagaaaatgttgaagactggtagtttctgaaattcttctcagagaccatgcactagaaacaatggaaccacagatttgctaattagaattattcctgaataatcattaaagcaaacagcagcttttgcgtttgaatttcacatgaaaattcaaacacttttgagaccaatagatagttgaaatagacctataggaacacaactactgaaattaaaaggtattcagttgcttgtttctgttcatgagtactagttttattctacagatagtacctacagtttgcagcaaataagccaaaacaacaagaaaatatcttgtttggttatactagaattcaatggctgttaatgctctattacacacttaaattagttttatgttttagttttataaattagtcttctctgcatatctaaatatatatttcctaatgaggtttaatattcaaggagataaatatgagaaaatgctttgaaaccaattataggaataatcttacataatctgcaaatgctgatcaaaatacatcatttctacaatgtcaatactgggaaaatatagctttattaggttgaaaataattattttgacttttatgataatggttagatttgattatatgtacatagggataaatacaacattgaaaacactaagccacataaatttaaaacatcgtgtaattcgaacagcttcttactagtggtttattttttaatgttctcattaaagttcctgatattaaattataaggaaaaaagacctaagaatttagacttaaataataattaattacttcagcatttgcccaagttcaatctctaatcatcactctcctgcactgtataacctctgtccagcccatctccacatgtccagtctcatcacttttaaattcatcatctacccagaaagcctacactgcataaaaccttttcatcacttttcgtattcagtagaataaatgcccaacttttctaacctactaacaagccctctatgactgtatgacttgcttcttgccttacacttcagcctaaagactaaaaaattggactgtcacagatccagaaacactagaggtttataatgctagttcactgaacacctggctctctggaaccatctttcagaaaaaaaccttctccctctaacttctcttttcctgttaactcctaatcatctttgcaactcagtaaagacaccacttcttctaggaagttttctatggctccctccctgacccaatacacatcctcacacttaaaagtcatcccaggaatgttggacctacccattgtgcgcccacaactctctgggaatctctctatcactacttatgttattaccatattttgttgtaattatgttactttacacccaatgaatctctgatctttgtgaagtcaagaaaaatgttttccccttcattgaatgcgtaataacaggtacctagacagaccatagtaaatgctggtagaatgaatatataaatttgatataattacatatgtccaaccaggctgcttataaattggcagtctggaaattcaagggaaagctttcaatgataatttttagattataaatacagtctgtacatttgtataagagtggtatcagctcaacatattcagtgatggatattatttgattatctgtattgctctgaacagttacagtttaaaaatatcaatccataatggggagtattttccatgccatgtatattgaactattgttctttaatacatggctaattaagtctttaacagaaatcagtactcacttcttccttcaactaaagttgaaagcttagcttaaaatgaattacttcattcctcaaaacagcaagttaaatttttcaacttgctattttattcatgtaatgctgtgaagtttacctgaaatttttaaaagtgcacatagtataagaactcaaaagtttttgaatgaatgctaaattacattgcccttcatcgagtcatacatacattttcttgctttcttttgtttcttcacattcaccttcatttcttcaatttccaccttactgtatatgagtattgtatattcatatggtcatctgattttgaaataaacccagtgcacatagcataatatgcttacaggtgaattcatcttcaactttcaactcagaaaatgccctatattctttccaatagtaatactctgtaatggcatggtggttggttctatcactatatttaagcaaaataaaagtagctgctaaggactaacaatttgctaaaatgctactgttcttgtatttaacaactaatatgcttgtcacaataatttactaatggggttatttaatgacctgataggattaacttcttttcaaagcaattaattacaacctgagtattatttatagctggataaaactggctcaaaccagctttgtgtgtttgttgattttatttatatatgcttgaaggggtgataattttgtaggtttcctagaatatccatttgataaataatcactaatttcattgtaaaaagtacaaaatatattacttttatcttaattataaacaataaaactaatgttcaataaaggtatcatccctagttgttccctctgttaaaataaaatgctttatttattctttgcttccttccaccccataaatgtaaactagtattaagacccatcataaatgtaaaattaattaacaatgtaatgtcccttgtatatacttctctactatgtcatacagtttcttcacactacttatcactttctgttctgtgtgttcctggagaggactcaaggttctttctctctctctcttcacccctccccaccaacctttagattctagtaaagccttcctactcaaaggagtaaataaaaccttactacttcactaagaagaggctaaagcaaagtgaactcacttggctgacatgttccaccttagaactttttctgtcttcactatttttgtgtcaatgggaaaaaaaatatcctttcaactttcaaaagcgaacatttctgcctatgttcttcttttctggtctcttcctgttttgctcactccccgcttaaatttaattatcatctcaaacatctgttttctactcacttctttatcttgccataaaatgtgtttatatttctatattaggaaaacaaaacccaactgacaaactctcacctcttcttctcccttaagccactgtatcatgatttacctctccataattattgtatgaggtaccatggaagtttgagaaaaccacaggtttgggtttctggttctgtcctattacatattagaggagaaataatttagcataatgccagttatgtttaaaaatatatgctcatttgatttaacatatagcatatatgtaggtatacatattagagttgtaatgaactcattattacaaattcatttgaagagggtaaacataaatcccaagatcaaagacttgcctacagtgttctctccacctccttccccctcattttcttgtgtgtataccaattagcctacaatggtagagaccatatgttcaattattcggcattatggaaacatatagaatcgaggaggactgatgttatgtttccataatgcataatgcatattttcctcccctactttaggagaatacaatatttaactgtgactatgggaaaaagttaattttagagacccatctagttgatacttgccaaaataagataatttttaaatgtgttaagacatatactacgctttgataaaataaaaaaaatatatagaaatccaggaacaaagctctatggaagaagcaaacttaaagtcaatcaaattacaataaatattgaaatttctcttgcagaataactttattggttagtaagaaaaagggaatgaatttacatatcacttttatgatgaacatgcatctatgaaataaatcttcatcagcttttgtaaaacaagctatatgttaattaatgttaaggaaatttgctttttaaaactccccaatctaatatttttaagtaaaagattttcttctcccattcatctctttttaaatatgtatatacatacatacacacgtgtatatacacatatacacacataatatcaagttttattttaaaaagtatatattttcacacataggaaatatttagtatttccaagtcaactttttttttttttttttttttttttacggagtctcgctccgtcgcccaggctggagtgcagtggcatgatcccggctccagctcactgcaacctccgcctcccaggttcacgccattctcctgtctcaatctccctagtagctgggactacaggcaccagccaccacatccggctaattttttgtatttttagtagagatggggtttcaccatgttagccaggatggtctctcgatctcctgacctcatgatccacccgcctcggcctcccaaaatgctgggattacaggtgtcagccaccgcacctggccccaagtcaactctttagcaggctcaatagtattcatgaataccagctgtgtacatcaaacagctgatattaaaacacagtgctcactttgggaggctgaggcgggcaaatgacgaggtccagagatcgagaccatcctggccaacatggagaaactccatctctactaaaaatacaaaaaaattagccaggcgtggtggcacgtgcctgtaatcccagctattcgggaagctgaggcaggagaatggctggaatccaggaggcagagtttgcagtgagctgagatcgcaccactgcactccagcctgggcgacagatcgagactctgtctcaaaacaaaaacaaaaacaaaaaagagtgctaacaaaagttagtcatcatgtggactaacctttttttgccctattatcatgaaaatccctctagccacacagattcatctaatatatgatctggtgaaaataaggatggggcaatggcaacaccaaaacacactatgaataaatcatgttgaaataatattcttagatacggaattagagcctattcatttcagtgtgtgtgaatatcacactctgtggaattggtagtcacacagtttcactgggctataattttttctcgttctgcatagggtggttatgaaaactaaatatgtaatctcgtcaatgccatggcatcttactgtgtgccaatttcagtgaaaaggtagtttatattatttctattactcccaacaatcatgaactataacatactgattgcatttaactagcttcaagattcatactagcaaatagcgaggagatactgccactagcatcatttgccacagccaaggataccaaatctacctctcctgcccacacttctcatattatttccccagaactaatcaggtacacctaagagcttcctggatatttccaccaggttgtcacaaggaatctcaaacgtaagaagtcaggaaagatctcataatctccccttattttattttattgggtaattgtcaccaccatccatttatttggtcaaaagaagtgttgaaaacatcccgacttgtacctatttcttagatctttaccctgccttctccttctgactcctgtccttcactaacagtatctaatcagtaaccaagactcattcattgtatttccttatgtttgtttcctgctctcagctcttgcagccctacctttggtcctcaattttctcttgcttgaattattccaatagccacaatgtaaaaatcacccagtgctggtcttgctcttctccaaaccattttcacagtgcgaccaaacctatctcactaatctcttacctctcacatcaaaatccttcattttccacagcacaaagtaaacactcaataactacagataactaaacacatttgcattgccatgtgaagtctcctgaatctggtcctggtttgtgtttgtccctatttgtcagcacacgtctctggaagtgaaaactctagcaagaatatagagctgttacatatgacattccctgtatctgggtgcactcctaatccctgccccagcatgtctcctgaattatccttttcctacagaggcttatagtctaggatgaatgaatagaaatatatacatgtaagtgagcaaaattttttggatgctcttatattgtgttatatattgtgggaaaaaaggaatagtcaaagtcacagattagaaaatatttacatgtctgtctcccccaaaactgtaagcctcttgataacaaggtcacattaatcacagatcaggaacttggtatttactgaatgagtaaatgaagttatataagcattaatgtgggtgaaatccttagcattattaaaattatgagaatgaagataatttattttattactactttaagcacatgactgttgatattttatcaatgataaagttggattctaaggaaacttataaatattagatttttcaaataggattttaaggtcatgagggcatatatatgtgtgtgtatgtgcatatatatgtgtgtatgtgtgtgtatatatatatagctataggtataaaactattcaaaacatatatatgtgtgtgtgtacatatatatgtatagctatgagtttagtactttaaactatagcttaaagtactatttcaaatagtattttaaggttgtgagggcataattaagtaaaacacacacaaatatacatgcatatattgtatatctacataatatatatataactatacattagttttataccttgggtataaaaactataagtcaaaagttttcttagtcactgccttattttgcttcctcttattagaggtcttagtagtccaaaacctttaacctctttagggaattttgcttctcatataactcgttgattttaggctgctttctgatcctacagaaacaagggtcttcgagtgaaaataactttaagataatgctgcctttatgaattttagtttttccttactctgccacctcaagcttccagttttcagaaaaaatgactataagttgtaaaaggctggaagctagaacacatgcacgcacacacacatacacaggggaaaagagagcatacttaaatatagtggaaagcagttgcagaaaaacataagattgctttaccactaaaagtctaacacatttcggtctctaccactgtaacagaaaacctcacagatggatcaatcactagagattaatactctgtcttttctaagccccatatgatctcgtattatcacccagaatgtttctgtcagaaattctagtaatatagctaccaaaaccacattagaatgggaaaaaaggcacaaacataacattgattcaacttgccctagagtactccattaaccaaatatttctacagtcaacaggagaggaaaacaaacatgcacacaaaatcccaataatgtatttacttgactgtgccagagtggtttgctttagaaaataatttgagtccatatacttaaaatgtttatattttagtaattacaaatagacattaatataataagtgatcatgcctcccataaaataacaatagtatttttcattatcaatcttttttcacattgttgtttttatttttgctttttctttttgtgtttttctaagtatcacaaaggccaatctgaatccagtttaaggcaaaaggaataaaaaattgaattagtcagtcttgaatttaataaatttttacaatagatcaaacagattttgaactaacatgttttgatccaccacaaaagaatgcatttctacctaatcacattatcttctaaatgaagaaaaatcacaaattctattcaatatccaggtatttttcttattcagtattcagatgagtctatctttaattaatttatcagtaatacttttcctatggtttttaacaaattttgctacataacaaatgtgtacttatttgttattcatagcaagatgatgaatatgcttgcataaaaagttaaggacatcttctaaaataattccactgtactgccctgagcaccttgaataaaaggaactatgctctggatggctttttgttatttcctggctgaagtcaataggtgctaattgttagaattcatcatgaagaatccagaggcagaacaataaagtgaaaaggaaaagttaaagaggttttatagaagtcctagcctagaggctaagataaatttttttgtatatgtatattttcttttttcttaagttatcaaaaattgatgtgaaaaataaaaccattcattaatagtgtttaagatatactttcagaaccatcagtcacttcacagaaactaatttcagttctcatttattccttctgtgatttattttattttattttattttcagaaccagaatctcactctgtcacctaggctggagttcagtggcacaatcacggctcattgcagccttgacctcctgggctcaagtgattctcccacttcagcctattgaataggtacatcccactctgcatggcgaattttttctttttgtagagataaggtcttgctatgttgcccaggctggtctggaactcttggcctcaggcgatcctcctgcctcaccctcccaaaatgctgggattacaggcatgaactaccctacctggccccttctgtgttttaattcttggttgtgtgtgtgtgttttttttctttgattacaaaatcaagtataaagttatttattgaagatgtactttaaaaggacaaaacactacactttagaaataaaaacagcagcttgtgttagtaatatttaaaaaaaataacacaagcatggtatcaggaaaacatatttttggatacacctttcaaataagctatttgctaaaacagtaattaaggagtgagaagcaaggttggtttctcaccatggggggtttcacaaaaattcagctattttaaagttctagtacaaaataatcagggatagctatctcttctgctacctatgttgttgttcttaaattccacaaacagatgcatgcatgcaaaacaagtcaggttctattagacaaaagttcacttgatttatatttcaactagatttccacttaaaatgttttttcttaaaacaagaagaaaatataagcaactaatgttcttaagtaattttttggtgcatcatctgctgagcaaatccgccctgctactcatttttttaaataaagttttattggcacatagccatattcatttgtttacatatactctaagactgctttcatactacaaatgtaaagagctgaatatctacaaaagagaccatacagcccacaacatacaaaatatttgatatctgttcatttatagacaaattttgtagacaactcactttattagttagaaatttaaatataagatattttgctatctcttaatagtcctctctataatttgccaattcaaaactggtcttcatgctgaatttggccctctatcttcatccctttggcatataatctaattgaggccctcaaaatatcaaaaaatgtgaatgccatttaatttttataggagaggttcttattttctaattcatcttgttgattaatcatatgtttatatacttaaaaattttttttatctatatattatcactgcaagtttctgttggtaacaagcaggctgcaaatgaaaagcaaatgaaaaatcattatatactacttacatccattaggatagctactatcaaaaaacacacaaaaacaaactagcaaatgttggcgatgatgtgaagaaactggaactttttttcactgttgatgaaatataaaatggtgtagctactttggaaacagtatgttggctcctcaaaaagttaaacagagttgccaaattatctagcaattccacatatggatgtgtggccaaaagagatgaaatcaaggactcaaagaaatatctgtataacctatgtttgtgggagcattattcccaatatccaaaagtcagaaaccatccaatgtccattgattgattaatgttaaacaaaatgtgatatatacataaaaaattattcagtcttaaaaaagaataaaattgtgacacatgctacaacatgaatgaaggttgagacattatgctaagtgaaataagccattcacacacaaaatatataatgtatgattccacccatactaggtacatagaatagtcaaattcatagatttgttgcttaataggtatagtttcagttttgcaagatgaaaagagttctgtggatgaatagtgctgatggttgcacaacgatgtgaatgtacttaatcccactattcacttaaagatgatgaaggtggtatattttatgctatgtgtacttaccacaatttttaaaaaagaattaatttaaaatattttttaagaaagcataaataaattttaaaaaatgattaaattctgccaacttaatgtattagccaagagtagggctttggtttcagagggacctcagttaaatccaggttctagtacttgagaaggttacttaatatctgttagacaccatttacataaatgtaaaatagagatatgaataataccaatccaaaattactttgtgagaattaaacatgactttgcacagaactcaataaatgtagctattctatttattatatttatatgcacaaagttcttatttttaaaatgcattaattacttttctaaatatataataacctctttaatttttctgtaacatataattgctagcacactgctaggtatattgcagaagcttaaaaatatgatcaaccaactttaaaatgtgatcaaccaacagtggcattaaaagagtaagagaagtggaaaaatacctgactgtgatacaatctccaaagacaaaagaagggctattttttcctgtaaaatggaaacttaaccagggagaaattaaatagcaatcagttttaaactacagtattctaggaatgataaatttattagtaaaatataaatgataaggctcaatagacaaaactaccaagtattttttttaaaaaaaggaaagaatagaaacacaaaataagactttaaagatccaaagcagcaattttccaattaaatattactttattctcataatggatgtattaatataatctttgactgattaacccaaataccaatatcttaatctccaaatttaacttatgaattaagagttggatgcacaacgtatctcagtaacaaaagcaaaatgaacatctgttaactttctgccatgtaagtttgtgtatggtgggggtgggtgtgaacagagcctctgatgtgtaatgttctttccatctgcacaccaggtggcactgcatggttaatcagaagatgacaacacacatcaagattccttacatattttgagataggaaagtaaataagtcaaaacgttgttttaaaaataaaactttcttagatgtccacagtattaatgcttaataatgcattttaagagtttatgtttctgacttcatattgtaatcattcttgcagtattgtttttcccataaattcctgacataacttataacagtactaagtaatatgagtttaagaaatagaaaagtaatataaccaaactagattgtatttgggaaggtgggaacaatatgactgttttggacacctcttaagccattcaaaggcaagatctgaagaaaaactgatttgatataaatttcaattgcattgcttctaaaatagatttacttaaaatatttaatgcagtcccttaaaagctttggtcttgctttagagtatacaggtgttaagcacttaaagtcaaaaaagctgtttaaatgacagagaaagagattattagatcactttaatcctgctaacgaaagatggcatagcttaactggaataaacaggaaataaggaacggataaaacataaattatcccccaaaatttcacatttctgtactttggtaagattgttctagaaagaaatatatatcatatatggaaatatgcctagtttcctccaacttgcatcaatccctgccatttccatgccattttccttttctcttactaacccctcttttcttctgtgtatgtcttcttcagttcaccaaactttacatagcagcgattcgtaagataagagctgtgtggtttgtagtgtgaaaatagctatccaacagtacatctcctagctctatttgaaaaccactgtgtactgtgcacatgaatacaatgtagtcttgaattctccacatttagcttcattgaattacagtgggcggaggggaagggttgtgtactgtgatgttccaaaagtcttcttgacaatatccactatctcagtaacttctaattttgttaagtatcctaaaatttatccttcaacatcaatattctacctttagaggacaatgcagacctatagtatgattaccaaacgtaaaacaaaacaaaacatcatgatgatcctaaggacaaatgtcatatgctgaagccctaatctcaaacatgatggtacttggagatggggcctttgggatgtaattagttttagttaaactcatgaaggtggggcccccatcatgggattagtgcccttatagaaagaagaaacgtcagaggtctttctctttccatgcggataaaccaaggaaaggccataggaacacacagggagaaggcagacatcttcaagccaggaagagggccttcaccagaacccagccatgctggcattctgatctcagacttctagcctccagaattgtgagaaaataaatgtttgttattgaagccacccagtctatgctattttggcatagcagcccagcaagactaagataatacccatagtatatgttcactaataaccccttccaggttcaaatgataattatctcccacaaaaaatgtaactggcagccataaatagcagttgaaagacaacatttttcttagttcagtaattttccaattctcttatcaacttcactttaagagttaattaaaccattggaaactactaaaagaaaattaatgcttaaacaatgaaaataccaaaaagaactgttttacttctctaatttaggtaactaccataagtaaaatatgtctttattccatgaaacatatatagaaaaatataataaaaattcctccatgtctccatccaaagaaatacaaagaagataaacacaaagaaggtaaatgcaaagaagataaaatattttaaaatataatttgtgttttataaaaggttttttaaaataaaaagaatataagctgtataatgttaaaataaccttagtgattaataaattatctccttttttacaataatacggaagacatcatgagttaatagggttaattagagttaataattaatcaatacttcaacagatatttattgatcatctacaacatgtaaagacttctacgagtagaaaaagccatgattttaaaaaacatttccttatatcatcatcttcatcacaaaacgctcattaaataccctagcgagtactaccattaaaaattaaccaaaaatacttaaagaaaatatctgatattcagcacagtaatgtaatacttgacataattataaggcatcaaagtaggaatgacttaagagtggctttgagtcattaatcagaactaatgaatatgtctttgcattttgtcaaaaacaaaaaaagataaaagaggatgcttggaaagatgcatgaattttaagcagtgaagtaatcaagtataatctcaaaatttctcaacaagttattacattgcttttcatttcttccattgtttcttttttttctttttccaattacttaacttcaaaaaactttattgatgttgtattatgtgttaagaaatgtgctgaaattatgcaattcaaggataaaaaccaacaccaactctcataaatgtttaatatactgtgtttgtgtgggtgacaggggagggatatatgcacacaaccaaaaatgacaaaaggaaaactatatactataaatgacatatatttcattatatatgaacacagaataaacttttcttttcttttcttttgtcttctttttttgtcttttctttttatttatttatttacgtatttatctattattttttttttttttttgagatggtgcctcactctgtcatccaggctggagtgcagtggaaccatctcacctcacggcaacctccccttcccacgctcatctcccataatcaaactatttaggaatcagtggcagtttggtgagcttggaatcagaacaagaagattcagaggtctctaaaatagacttctctgtctatcttacgacctgggctcaaagaactcccggtccattgattcaggtgccttaaaagagccactgtcaatattgctgatatttctgcaggttccttttcttcctcaatacttctaaagatgaccagcccccattgcctgcttctgcagattaatatgtgctttctatagatatgttaatatgatcaaagaataattgccctacatctattttatctccttctggggctttgcatgaactcattaagtaatgatttaatgaactctcagctggaattctatttccctcatttccaaaatcttgggagccattttacaattacaccgaagtacttacaagtgacagtagattaaacaatattacaaattaaaaaaagtagattggcaaaatactcaagacttgctttttgcttaaaattaagtcaggtttattttttaaaataatctattcatagttgtggatagtgactaaacaatttacatttttatctggggacagaagtaaagcaaatggtctaaaaacttaattgcattttcctctgaataaatagaaagtatacacaactatgtacaatttaaaaattcctgattaagaagccaattaagaataacttttatagagaataattctggctttgtgaaggcatgagagatttaactaaaggccactctgtagcaaatttaataccacaatctctcgatggattttttaaattataattatctgttatttgtctgttataatatttgggaatcttcacatttaaaaaaatattattttctgatggtaactaaaagaaaaccaatttgtgataacaatgagaaaaatgaggctaaatataaagactaattcttcttgagtatcagcttaccctcttcaagaatcttaagtgagatgctgaaatgtagacagagtcatgttggctttgagtcacaattgaagtatggatatttgcacttgttatttttttttttactttctttataaaactcactttccatgctttagttgccatttacttcttttctgttacctttgatagtcttaattttcttacccatcaaagagtgttaagaatatcgacatcaaggaccattttaagagttaaaaggatagatcatgttaagaattgagcctggaatattattcactgttactgctattattaccaatatcaccactgctaatatcactattcctacttggaatagtgtaataccaaaattataataatgtaaaatgtattccccctgggtttgggcaatgttataatactccaaaattgccaactttgttaagcaacctataaatttactttattttggaaaacagtcaaaagagttgcattttaaaatcaataactaaaaatacgtataaagttcctactatgtacccgccactttgctaggcaccaaacatctgtcaatgaagaaagcagacagaatctacagtctttaagaagcttaacttctagtggtggaaacaaacatgtaactagtgaattataataaagaaggtgaagaagtgctatactacagtaaaaagtccagtctgaacatagagagcaggaacacagagtttgtgtggggtggggggtgaggaagatgattcattaatccaggctaaagtatgaaggtagggagtagatcatcacaagtaaaataattgtatcaaatagaaaaaaagcatcgaagtcaagaacacaaatatgaaaacaaagatagctctaggtccatgtccaaaacttgaggttaaaaaacttcagataaggtaaaactaaaaacagttcagaatggctgaatcacataatttaataggagaagtgactagagacatagctgtgaccaaatcaagaagagccttgaaaaccttcgtggggacttttctttatctggaaggaaatatggagctatggaagagttttagtgaggaataatgatcagatctgatttcagcatgattactacttttgttgtgtgaacagtggtggccaaagagactggttgaggccatagcagtatcccagtggcattaagtgaggggagtggtggtagcaagaagtaagttcaaggaaaatcttttgggtggacacaagtaaagcacttggtgttgaaaaagactattcatctctacaacaccttcctgtagttcctgtttcgtagtgtctactgtgactattataattgatttcactgcattttccccttagccccttctttctcatgcattctaaaaacaaaaattcaaagaaagaaaaacttggcagaagaacatataaagtttgatcagttacctaaatgtgtcttactggatgttctttcccttgcatgcttgtttaacctttttggcactatcatgttttatgaggctatgagatgaaaactatcagaagatgaacaatcagaaagagaaaaataaatgggcttctttaaaacaaagacgaagggtccatctcttcagttatctataacagtgactcttaaacctggctctagaataaaattacccacagaactttaaaaaaaaaaaaaggaactatacccatgtccagcccgtctaccacactacgtcccactcctgaaattgtgcaatatggttgttctttttgaatgtcttatgatatttctgactcaatttaataccaacctaaacaacgaattcagatttctttattgttttttaaattcttagcacagtgtttgggacattgattgtagtaattcaatacttatttaactcactaatagctacttattgataggtgttgagtatactatgggaaaaaggtgtttagtccatcagagcccttacattgtatagcattggctatcaaactttaactagagccatatttaaaaaatacattttattttaatgcagtgtgaacgtgcaagcacacacatcaaacacacatacacacaggtgaaaaacatttttcacaaaataacacttgccctaaccatagccaacacactttgatatgttctattctattattttctggttatttttataaaataaaaaggaagaaacaatggttgtaacctattatgtcaatttcaataccaaacaaagagagccatccaatattttttaaaagccttgtatagtagatgttccaattctacgtctcaatattttcagtaacatgctgtccaggtgctctgatttcagtaaaaccaccaaaactttagagtctttaacaatgactcaattactgtgaagataacagactaattttgaataagacatagggctttatctcagtacttagaagaagctaaacttctcatggttcaagagacataagtctttagaagtaacaatgatgtacattcaatgagataatttccttggactgtggtagtattagagaaaactctaaaaatgagagacttttcatgagcaatatcatgcactatagttaaaatcaggaaacatgtgaacagacttgacttaatacaatgggcttaatgagctatcttcattatgtcatagttaattaaaaatattttttattttacacaatctaacgtagaataagatagtagttataaacacataagattaataactatggcatttccaactacagaaagagaaagtatctctttttttttttttttgtagacggagtcttgctctgtcaggaggctggagtgcagtggtgagatctcggctcactgcaacctccacctccccggttgaagcgattctcctgcttcagcctcccaagtagctgggattacaggtgcacaccaccacacccagctaatttttgtatttttagtagagacggggtttcaccatgttggccaggatggtctcgatctcttgacctcatgatccacccgcctcggcctcccaaagtgctgggattacaggtgtgagccaccacgcctggcctaccatctccatttttaaaaactacctatgtaaccaacatgtatgcaccaggtactaagagtgttttctttgctactaagtactttactgatctcctgtgtcaaatactaatgatgatgcacacctgtaacagagactttcatttctatcctctctcaatatctgtcatcccctttccctatgattctagacgtttgatggggattatgtccacccagcaaaaggcaatacttcccagcaccctctgctgttgccatgcttatatgatcaggtaacagacaatgagatgaaagaagaattgatttgtgtaacttccggctcataaatataagactgaaggagctgcttccctctttcccacttctattagcatgaatgtgaacatggtaactacccacagaccaaagacggaattcaggtttgaaaatggcttacattgttacatgagaaagaactaaacgtttatattgttttaccctctattgttttctgaaactgcccaaatgtatatcctaaataatatggaattcctattctacatttcctcctacaaaatcagtgagaaagggtagataaaataagtgagtaatgtttaattacaatatggaagcaaggttaatgaacaaaaacatgtaaggttgtgtggctgtccaagtaaccgccagttatatggtaatacaaaggtcataaattcccaaatcgacactcatgagtgtcaaataaacatttcctagagaatacggctacttgtcttccacagactgaagcttttctttttgacatgatgaaatttttctcgtatatgtttcatacaaaatactgaaatagagcataactgcattcctcacatcactacaccaaaatgtcaaagattcacttctcagcatgaaaatgcacagcacataaatatgaaaggactctacattctaaatgctgtattcacacctcagtgcagagtcaaatggagacaactgtattgtgaaccagtatagcattatcaaataatatacttaaggggacttaatagtataaaattaaattaaaaagctgaaacactattgattatttcagttagaaggtgtttcgtggttataactactcagagtgataaacaatttaattattccacatttttggaataatttgcttatgtaattaatttggatatttcaatgtattggttattttattggtccatattccttcagtacaaagattctttgtagatgaagttcttacagatacatgtattaataattgtattagtatatactcaaataatggaaaacatatcttttagtacattggtgaatttcaaatagttatttgataacattattagtattgcagacctaaagcctgatgaaatttttcacttattactgaccaagcatttttgatcatgtgtttattgagagtaattggaacttacagacacctgcccaatttctttacattaaattatcaatacaaatgtaatgttgaaaagtaaagctaaagtcaaatatagtatgcctaaaaatagaacccagggaaaatatcagatcttgcctccttcctacttttgatatacacaataaatataatattgtaattaagatcatacagacagatactaatgacaatggcacccaaaattttctgaaaggaaggaggttcagttgagacatttaggagctagaagacagtgtaaatttatattgctttccataattttttgcctaaataaaggggctgacaggcatggtcttagaaatggcattttgataagaaaagtttagtagacaaagaagcattaatgatgactgcacttcagaaaggcaatgaaaaaggacagctgcaaaacaaacattactcagtgtgtgatcacttaaagagatattatttcgaacttcatattctgagtgtgaactgccgaagagacagacaaagtaaaatacaggacgatgagtttatattaaaaatgagtaacaatttaacacagtggtccccaacctttttggcaccaaggaccagtttcatggaagaaaatttttccatggaccgggttggagaaagaggatggtatcaggatgaaactgttccacctcagataatcaggcattagttacagattctcataaggagcatgcaacttagatccttcgcatgcccagttcacaatagagtttgcactcctatgataatttaatgccattagattctaatctaatctaatgctgatctgacaggatgcagagctcaggcagtaatgctcgcttgcccactattcacctcctgctgtgtgaccaggttcctaacagtatagtactagttcgtggccccgagtttggggaccccgatttaacatactccatttatatgccgtaattgcccatagtacaaatcatatcagagaatgaatatgacattcatgaggcaaagactaagtcaagccaacttacttgttctctctggtctctcagtaaacactaagtggaagaaaaatgttagaaaactcattctccataacatatttaggcaaaatatgagaaaacagtatacagtgagtgcctcaggagtaatacactgtctatgggactttcagaacactgatgaaacatttaaaaaattcaaccaaataagaaaagtctttagaaaattttggaaaatgaatagcaaagggaacgagccaactccatcctttatgatcactttaatcaattgtttttatcataaaaagaaagctacagcctctagacagattctgagtttctggtggtatgacttgaaaatattttcttcctagagattctcactggtgatgatggtgtggtgaaagaatgggaagataaacatcttgccgaaatctctccataattaaggtgaaacagcactcctacttataaaatagaaatttagttacttggccaatcatttctatctgttattccctgaacaaatataactttcatcacgaaaatgtctgaaggcagtcattcttctggatattgctaggaaataaaaaaatacattataaataaatatatttaagagtaaactactcacctattccaatgaaagcagctttgtagcctttttctttcaaagtgctaagagtcatttcattcactgaaaggcttttaccgcaaattatctataagaaacaatattttgcataagaaaatttggcatatgattaattaaaatcttaatatttaacatcaaaaagaatgaaaagtcagccaaaaattctatgagattccatataaaatgtgacaacatttttgtcttttagtatataggtttacatacacaaaatagtatataaatagaacaggaacatgttctattaagggctaaatgcagaagaaaagccagtgtcattaaaaccatcagtaaacttccatagcttgcataatatgttcaaagcacgatgtggggcatttaaataataagacgataaataagacacatttccagcatcaatgtacagtcaagtaggggcaaaagatatacacaaataaatgtaacataaaacaagctatgatcaccacatgtgtatgagagttcagaggctggggagattcattttagctaagcttagaaggttgagaatacagagaagtgggatttcaatagggcctttaaaaggaaaagacaggattttgataacggacagtgtcaagggaaaatgaataaagtcaggaagcagagggtagtcacccctagtaaaagtcacaatgcttggtcagttcccagacatgagataattttcacttctggaacctgctgaccagggaggtgtcagggtccctaggaagaaagaccctgaaacatccctacaagtaagtactgtgattcccctagtcctttcccaaaggaaactatggtcatttatccaagcaactaagccctggaaaaaggggaatgatcagacatttcaaggactattaagcactggttcttcagtaatactgatacttggaaacataagagtgggtacttacagggtgaggtaaaaaatggagcctgactgaagtctagttcacagtgggcccactgaaaccacaactcagttagtgatcgttctcctagtctctaagagcataattgaaattgttacatttgtcaattgaagtaatccctacattgggtctctggtctgtgaagtaagagctataaaagctatcatagttgggaaggccacatgaaaatatctgaaaatccagccaagagactaaatcaaagataatatcctatcctgggtgcaatgggatggggagagatgttagtggtccctgtcatatccccatttaatccaccagcctgtcccctgccaacaccagagaatttctggaggatgactataaatgtctgcaggcttaactaaagagtagtcctgattgcagtttctgttacagatgtggtattattgctagagaagttttataaggccacacatagactgcatgtggccattgatttggcaaatgcatactccttccactccaattacagaaggagatcagaaatagttcagagtcacagagtatagataagaatattcatttacagttttgccttagggatatgtcaactcttttcagtaataatatatgtaatctgaagcgatctggacatcccacagaacgtcacagtgattcattaccttgacgacatcaggcagatcagacagcatgaaaaagaggtggtgaatatgctggaaactgttaagatatctgcactccagtgggtggaagatgaactctataatcagggactggcctcttgagtgaagtttagagatccagttatcaagtatgtgccagtaagtccccttgaaagtaaaagacaaatagagctgcatctcacatttcctgccatatagaaggaagcacaatgcctggtaggtttctttgtgttctgaaggcaaaatgttcctaaaaacaaagcccttaagctgagtcatagaagaagagcaatgtatacccatgaactggtaattacagctacactgaatagtgcacctaagtgtaaagctctcttctaagtactgcatatactgactcatttaatccccacagcagccccatgaagtgttatcagtattttcattttacagataatgatactaaaggacaagagagcttacataacctttattgcagtcaaatacatagtctaatttcagagccaacatgcataattgctgtgctcttgtgcctcttgaggttagagggcagagctggcaccatcctcaaggacaaagaacagcatattatacgtgaagacctactaaaaaggttgtgtttcaagaatataaagtgcaaagcaagcaatggagcaagaagttggagaggagaatatgactggaactggatcatagagggcaatgttttgtcttcctaaaatagtaattctgtttttatattggcagatatggtaactgtcagaaagtttataataaggggacaaccaaggtgagattaataacgaatattcagaactctggaatgtatcaaaaaacattaaactggaacattaattaaatatgtattattcaaagcattttatagtaagtaatagtattactattagaattagtagaattcgatgctattaaaatcatctaatagtgaggctttagaactttaatttattctaacttttaaataatacatattttattgaaaaagaaaaataatttcgctgtttgttttatgaatcaaatacccttcataccaatatataataaaggttagacataaaagaaaacaccaggtccaaacattctaatagaatattagcaaactgagtaagtatgccattttcaaagttgagcactggaatgccatgccaatgaattaattggtggaggtgattctcaaaatacttaatcttaggtttactttattcagtgcctctgcaggaagattcaagaagacctcccatcctttttgaggtgggtatttgtgggagaaggcacaatagtttagtttaatagtagctttttgtgatttatcaaagaggaataaagacatcccaattcttccaccacagcagagtgaaaatgtctttgattttgtaatatataagaaagatgctcattctgtatttatacagtctgattctactctaatacacaatagtgtgcaaatggggatagaaaacagttgagttttcctttcatgtatggaaagctgcaaagatgagtatcttgatcttggtgtgaatctactgggatggagaccagcaagacttgactttaccatgaacagacattgtgggaaagatggaggatggtcatcactgggcagcagatccctggtagaaatgaggacaaagccataacaagaacattccaagcagtgacaggcacaaggcttccttcctttttgtgaatgggaacctattcaaatttccctttcctaaaagcctgaggccccaaatatttgccatgcaagaaataatctattcttagaaagaattagaagaaagattccttgacaacaaaagtaaagctttgcttacattatgctttgggaaattgaaatgaaatgtgtgttaactaaaactggaattgcaagacaactacagctatcaggaacatcatgttggctgataagctatgaaatctcaatgttatttgttaaatatatatgatgctagaaaaatcatattacgggcattttgtttggtgtttttgtttctttattccttgtacttttacatatgtaatatttccatcttgattttcttagatatacattctaccttcctctaatgactttagtaacatattattagatatttcctacctaaattcggaatacaaattcaatctatttcaagttcagtgtaatagtcactactttattccagcagttctgaatgtcatataccctgagccaaagttccatctaatagtctcttagggatttgatgaaaactttctttatatactataatatgtattcatatacatagtaacatttattatgcaggataaaggctgacaacttttttgtggagtataaatcttcaaataaaataggtgatgcccattatttttaaaaatcaaataaaaacatacatactcttcacagttgtctaatagaaaatttggttaaatagaccaaatatttccagatgctctaagatagaaaataaaatgaagaaattttgaaagtatttagctatctttagaaatgaaaattatttattagctattagtgtacatgtttccttgtgggagagaaataatatgattttatatttattttctaatactatctcataatcacagatattattggttcaaataaccatagtgaaaacaagatgttataagaggttattaagaaaaaggtaatacctctattagatatttcatctaaaactacgaagcagaagaaatgtatagaaattacaaattaaggtaatcaattagaattctatcagaatactttgggaaatgacaaatatacatattttaaatatgcaaaaatgcaatatcttcattcatattttatacttttaactttgaaaaattaggatataaagaccatgaaacaaaaatatgtatttctatttaaattctgagttgcattacaaaaaaaggtataaataaacatcagctaagaagccatttctcctaaagggaatacccaattttattacactataaatgatcctttggtgtaaaatcaattgagagtatgcttgataaatttaaaaaatgcaaatatggctaataaagtgaaaaaataatgaattatatcacaagaatacagaagcaaatgaaaatactatcctacataactgttgtctacacgggggaaaaaaacctactttctgaagaaaaataaaaataataaaataatgaaaacacatggatgctgacaaagatttttctgaaactaataactttaaatgttttcattattcaatctataaaatgaaaatgaagtaagtttacaactcaagattttacagcaaataacaaataagttccactctgatcttgcttatttcttgtcttctgctagctttgtggatatttttctcttgcttgtctagttcttttagttgttatggtagggtgtcaatgtgagacctttctagctttctgaagtggcatttagcgctgtaaatttccctcttaacactgctttagcagcatcccagagattctggtacattgtctctttgttctcactggtttcaaagaacttcctgagttctgccttaatttcattgtttacccaggagtcatacaggagcaagttgttcaatttccaattgcgtggttctgagtgagtttcttaatcttgagttctaatttgattgtgctgtggcctaagagactgttagttattatttcagttgttttgcatttgctgaggagtgttttacttccaattatgtgatcgatttgagagtaagtgccatataactccaagagcggaactgaaggagatagagacacgaaaaatccttcaaaaaaatgaatgaatccgggagctggttttttgaaaaaaaaatatatatatatatacacacacaccaataggtagactaatgaagaaaaaagagaagaatcaaatagaaacaataaaaaatgataaaggggatatcaccactgaacccacagaaatacaaacaagcatcgaagaatattataaacatttctatgcaaataaactagaaagtctagaagaaatggataaattcctggacacatacaccctcccaaggctgaacaaggaagaagttgaatccctgaatagaccaataacaagttctgaaattgaagcagtaataaatagcctaccaaccaaaaaaagctcagggccagatggatttacagctgaattctaccagaattacaaatagaagctggtaccatttcttctgaaactatttcaaacaattgaaaacaagggacttctccctaactcattttatcaggccagcatcatcctgataccaaaacctggcagagatacaacaaaaagagaaaacttcaggccaatatccctgatgaacattgatgcaaaaatcctcaataaaatgctggcaaatgaaattcagcagcatataaaaagcttatccatcacaatcaagttggcttcatccctaggtgcaaggctggttcaacatatgcaaattaataaatgtaactcatcacataaagagaaataaagaaaaaaacacatgattatctcaatagatgcagaaaagtcctttgataaaattcaatatcctttcctgttaaaaaattctcaataaactaggtattgatgaacatacctcaaaataataaaagccatttacaataaacccacagccaatatcataccaaatgggcaaaagctggaagcattccccttgaaaactggcataagacaaggatatcctctctcaccactccatttcaacacagtattggaagctctggccagggcaatcaggcaaaagacagaaataaagagtattcaaataggaaaagaggaagtcgaactgcctgtttgcagatgacatgatcccatatctagaaagccccattgatcagcccaataggttaagttgataagcaacttctgcaaagtctcaggatacaaagtcagcgtgcaaaaaccactagcattcctatacaccaacaataagcagagaaccaaatcatgaatgaactcccattcacaactgctacaaagagaataaaatacctagaaatacaactaacaaggaaagtgaaaaacctcttcaagaagaactacaaatcactgctcaaagaaatcagagagggcacaaacaaaaggaaaaatactccatgctcatgaataagaataattaatatgacaataggcatcctgcccgaagcaatttatacattcaatgctattcccattaaactaccattgacattcctcacagagttagaaaaaactactttaaaattcatatggaaccaaaaaagagcccatatagccaagacaatcctaagccaaaagaacaaaactggaggcatcatgctacccgacttcaaactatactataaggctgcagtaaccaaaacagcatggtactggaaaaaaataaacacatagaccaatggaacagaacagagatctcagaaataagaccacacaatacaaccatctggtctttgacaaacctgacaaaaacaagcaatggggaaaggattccctatttaataaatggtgctgggaaagctggctagccatatgcagaaaattgaaactagaccccttccttacaccttatacaaaaattaactcaagatggattaaagacttacatataggccgggcgcggtggctcacgcctgtaatcccagcactttgggaggccgaggcgggcggatcacgaggtcaggagatcgagaccatcctggctaacacggtgaaaccccgtctctactaaaaatacaaaaaaattagccgggcgtggtagcgggagcctgtagtcccagctactcgggaggctgaggcaggagaatggcgtgaacctgggaggcggagcttgcagtgagccgagatcgcgccactgcactccagcctgggcgacagagcgagactctgtctcaaaaaaaaaaaaaaaaaaaaaaaaaaaagacttacatataaaacccaaaactataaaactctagaagaaaatctaggaaataccattcaggacataggcacgggcaaagatttcatcatgaaaacatcaaaagcacctgcacaaaagcaaaaattgacagatgagatttaattaaacaaaagagcttctgcacagcaaaagaaactatcatcagagtgaagaggcaacctacagaatgggagaaaatttttggaatctatccatctgacaaaggtctaatgtccagaatctacaaggaacttaaacaaatttacaagaaaaaaaccaaccccattaaaaagtggacaaaggaggccaggcacggtggctcatgtctgtaatcccagcaatttgggaggctaaggcaagcgggtcacttgagatcaggagttcaaaaccagcctggccaacatggtaaaatcccatctgtaacacaaataaaaaaattagccacgtgtggtggcagccacctataatcccagctacttgggacactcgggcaggaaaacagcttgaacccaggaggtagaggttgaagtgagccaagatagtgccactgcactccagcctgggtaacagagctagactccatcctccatctcaaacaaacaaacaaacaaacaaaaaacttacgtaaaggacatgaacagacatttctcaaaatgagacatttatgtggccaacaaacaaacatgaaaaaaagctcaaaatcattcaatcattggagaaatgcaaatcaaacccacaatgagataccatttcacaccagtcagaatggtgattattaaaaagtcaagaaacaacagatgctggcgaggctgtggagaaatataaatgcttttacactgttagtggaatataaattagttcaaccatgtggaaaacagtgtggcaattcctcaaagacatagaaccagaaatactatttgacccaacaatcccatttttgggtatatgcccaaaggaatatagatcattctgttataaagatacatgcaggtgtatgttcactgcagcattattcacaatagcaaagacatggaatcaaccaaaatgcccatcaataatatagtggataaagaaaatgtggtacatatacaccatggactactatgcagccattaaaaaaattagatcatgtcctttgcagggacatggacagagctggaagccattatcctcagaaaactaacacagaaatggaaaaccaaacactgcatgatctcacttacaagtggaagctgaacaatgagaatacatggacacagggaggggaacaacacacactggggccagttgagtggggcagggacagggagagaatcaggataattagctaatgcatgtgaggcttaatacctaggtgatgtgttgataggtgcagcaaaccaccatgtcacacgtttacctatgtaacaaatctacgcatcctgcacgtgcatcctggaacgtaaaataaaataaaataaaactaaatttaaaaaagagactaacaaataagaatagcaggggaaagcattaataaatatatagtcagcaattaatgaataagaaaacaaaactttgataactgtttattttaaagaaaatattaactggataggaaaacacaaaggaaatttagagatgcaagagcaaatataatcacaggcacagatgacatatttttattgtatactgaaatagtagacttaaatttttgctaataaattcaaaaacctcaatgaagcagaaatttttctagaaatatattggcaaaattgatacgagaataaaatcagtggaaaaaacttatagacgatatgaagaaaaatggtcatagttctatttcataagagggtttggagaagatgacaacttccaaatttagtaaaaaagatgtctcaagataatattcttaccaatgagaaaataataaaatgcttagaagtttaattttataaggctaatataactctattatcaaaaattcacaaaacaacaaataaaaataaagcaaaacaaaacaaaaagtctttgcacatttaaaacttgtaatggtaacaacattatttgactgttccctgcgatatttctggttttaatatccattacataaataaatgaatgcacaagaaaaattttaaaaatactaaccaattgaatctgaattacatgtacagaaataaacatgatgccaaaattgataaattttagaaattcaatgattagtataattcaacatataaactcaacgtaagtatttacaaaggggaattgaaaaatttaacacacttttgattaactttttaaattaataaaatgtattaatgtaagactagaaaaatatttattcaatatgattaaaaatcccatttcagagacaagaaaaagaattccatgtattatacctctttttttttttaacatactagatattgaaattgtggaagaaaaatatgaataatgtacaaataacaaacaaaattatctttattctcttgtaacatgatatttgactttaaaaaattaatcttagaactaacaaggactgattggctaataagataaattgaaattaaaatattcaataggaaatgcagctaaaaaaagatagttgggagtgaagataaagaaactgaactgggttctggatataatcaggttatgttatttggatgataatacgcttattaaactactaagtatacaggactggagttcaaaagaaggatggctctacatggttctagtcctggcatactacttggcaaaaataagttctgaacaattatttgttgagtaaatgaaataaacctctttgggaagtaaaagagaaagtagaagaataaacaagataatgctaggtcatgaaagtcaaaatacatacatacatatataagagaactcttacatcatatgctacacgggagtcaaacagtatgaacccacaaaaatagttcatttcattgccaggaaattatttttgactttaaaatatatattagttgagagagacaaacagaaggcaaattataaaaagaacctccgtgatgacttttcaaaaggaggtaatgagcacagaccactttgtcaaaatgtacccacttatggctaaagttcgtaaatcataaaagctgcaagagtatctcatcaaaggatacaaatcctcaaagtgaaaaggaatctcactgctatctttcctcagaattgtatatacagtttattgtttacaaagcaaatttgaaaacatcatttccttcacatcttaaaacagcttgagagatggacaagacagtactgttagctttctctttaatttaggttccattttttttcctcaataatgtaacagattcacagtttaaaattcaaatgtacaaaatgttgaaaaaattgtcccacaccttctcaaaggcaatctgttctatcagattcttatatctttctgagatattctttgcatatgtaaacaaatatttttatattttgttcaaatattagtagcatactttttatttgagcagattttgaacaacgttctagatattaatagactttgccaaagatatctgacaaaattaaaaagtggcatgactatagctaagatatatttcttggcactcagtatattgcctactactgcaccttgatgagttttcaaataagagtaatgggtatgctctaatttatgcaatatatctggtcctgtgaaaactgaatgcaattttgcaattttatataagataaatggagaaataaagcctaatttcttttttcattttttattaatatataataattttacatatttatggggtgatacatgcatagaaagtgtaatgatcaaatcaggataattaggatattcatcacctcaaacatttcccatgtctttgtgttgggaacattcatcttcaattcagaataccgaatctaatagttggaaatttcaataatcatttccatatttgatgagatttagagaagaacttgtattcaaaatgaaagacatttaaaaacttttcagaatgtacttctgtaaaataatcacctctaaattatctattttgaacactgtaattttgaacattaagttttataaagttgcccaaatctatactatgtgtttttattcccagacatcttgtttagtcattatgtgtgaatgtttcatcacccggccactgtcaattaaaacgtaattataaatataaaccacaaaatatttttttgagtgttttctcttttattgattcattttaagttttactggtaaatgcaaaaggtatgagtagtttgttaatcacttttcaaagtatcttctgcatatacttacagcatgtattatgtaaatcacagtacattattaatctattgtgttatatctattatgaaaaattaacatttttgaaacaaaaatagcaatatgttcaagtgaagagctagaatataatgctcttaacagaaaagaagaggaatatttaaagctatatgctgaaaataacgatgtgtcaaattttcaaccatctcgaaaagaataacacaatatttatttaacaaaataataaaaaatacgaagctgttgctttctatcccactgatttactgcttgtgttgagaaaggattatcacattcacactactgacatgatgaatataacaaataaaataaatctccataagaaattatgttccaaattgtgaaatactaatgtttcagagtgcacacaacttgcatgaaaaaacatgattaaagaaaccaaatccttctattagctgcactgaacccctaaagcaatttaggaatttgtttcttacagacaattaatcacatgcaggcatgccagatgagaactattgattgcccttttccaggctagtggcattcagacagtagacagacaaatgccctaagcaaggggaagcatctttctgcttctgcctgatgtagcttttaattgttctttcctaaaatgcatgacatttgctgttaatctttagtgtagagcttactcctttctttttgagcagtacacagataggtgtttttttcatttacctttacaccaaggtccttcattagctcaatctcaaaattcactacatcatacggcagccggaactgaggaatttcagaagtactgaaaagaaaggagaaagaaaaacaggcatcagtagaaaaatgaccaatctttgaccaatcttaaaaaaaggtaacatgtctttatggattagtagaaaataaatatctcttccaaggatatttatatatcacacaagatatgcatgaggacatctacattcttattgatataaacatgttacgtggagtgaagatacagtagaaactgatataaaaataactaaattacagcaacagaaaatgataaatataaaactggccaaaagcaatttcaatacttttaagttcaataaagtatttggttgatttatttaataataattctataaattcctaagataaaaaatcttaaaatctattaataaagctagatggagatatagattttaatatatgtatacacatatatatatacactaacattcatatacatagtctataaatgtacttctagcttgttgatatgcaaatgtgtaactgtattaccatactgtttagaatattacaaaatcagttccatgtgatctatagaacattttagtcttctgtgaaagcaatgagtattccaaaagttcagtcattaaaaaacaattctattgtatattaatgcctattgcctgcatttaaaaaaaaaatgaggcctatggcactattatttgagtagtataatagagtattaaaagtaagctaaaaacactttccagtgttttgttaacaattaaaaaagctatgtatgtccatgaatacacagcaatccattcattcattcatttgctgaatcattcattcacctactcattaaaagtgaatagtgccaggcacagtgtttacgaagtgccagctaagtgtaagctgcaatgatttgatggtgaatttcaccaaattctcactgttaataagttctttttctgatcagggaaggatacacaaaagataattacatttagaatgtggtacgcacaatgagagaagtatatccattatatctttaatgtgtatatatacataaaatagcaatcatattttatatattatagagattaatttggaaaataaataattgttgaagatgaatcttctggatcatcaattgaaaaatctcccaaagtacagccttttcattgtttgatgacttaagaacttgattatgcaattaatttttatatatcaatcagcaagacatcatgctcaatgctatagaaaatgcaaggtatccgcggtggctcacgcctgtaattccagcactttgggaggccgaggccagcggatcacgaggtcaggagatcaagaccatcctggctaacacggtgaaaccccgtctctactaaaaatacaaaaaaattagccaggcatagtggcgggcacctgtagtcccagctacttggaaggctgaggcaggagaatagtgtgaacccgggaggtggagcttgcagtgagccaagatcatgccactgcactccagcctgggcgacagagccagactccgtctcaaaaaaaaaaaaaaaaaaaaaaaaaaaccaaaaaagaaaatgcaaggtatcaaacaccataaaatcaaagctgtacactaaaggagcttccctctagttaggaatacaagatgatgtttaagaatgaattcaggcatagggcagggataaaaatctcttaagccaacttgtgaactccagccacattacctcaaggtaacaagaatgtgccagaatgctctgggcaccaagaaggttttcccttcaaagtctaagtagaaagattcttaacaactatggactgtatgtggacacaaacagacacacagacttgatagacatggggctgcatgagagggagattaaatatggactaaaactgggcactgatgcagatcctcaaaaggttgaacaggaaagcaaaagcaatggactatgaacaaagaattccagccaaataaaccaactacaacaagatgagaatcttaaatacatccagacacattgtgaagccgagaaccttccaatgagtcaggcctactcttggatttttatgggatgttaagtagaagcacatggaataaaaggaaaaaaaatggtgtgagtgcaagtcaatggttctgacttaagaaaaaaactctgaaaggcatgttataaaaagcagggacaacttttctgttggtcagaaaaaaataaaggaaggaacacctaacctagcaggaagacacctgagaaaggaggaaggggcagccaccacccttggcagtataactttgaatgcagatgcaggcaccagagaaaatggaagccaggctgctggagttcagcaactctgcttaaaaccccatgctgctctggaaccattgtcaccaacacttagcacagtgttaaacgaataagtgtgagagaatccatttcccagcatctcctgaagcaaatcagagaaatatgaaatactgagaaatgttagatttggttacagtcaagtaggtagggggtaggtggaaattactgattgtgaaaaatgtgacgtttttatattcactaatggatgaagtcagcaaatagacgaaacacatacacacatacatcagcagaacaacatgacaaatgtaaaatactaaatgtgaacaagtgtttcaaaggagggaaggcttattgtgggatgagataagtgggtaggggaaatgtcttaggactttaaaatatcatcagtgtatgatggcttccacatttttcttcttaaattccagacttttatgttcacttgggtgtctaatgggtaactcatatttatcatgcctaacagtaagctttggttcttgcatcccaacactggtcctcagacaaccccattttatgagttgctcaggacctaaactccatcatcacacactattccctttccagccccacaccaagcccagatgcaggcagtaaagtaaaaaggtgtgttctttttagacaatttaaaaaccattataaaacttactaaagtgagtctgttttgtcttattttcatgagctagcaattctaaataatatcactaatatcctaaacaatgtcctctgccaaaataaaaaaaattctctggtgagtctaaattctaaacaatagccatagttgctattgagttttagtaatatatatgtaagctttcaatgatcccatttttattaccaactctttaataaacattgtgttctacaggaaagttaacttgcagaactacagttaaatagaggccatcagcaactgctgattcagctacaggcattcctcattccaattccccataggcgacatatgcctccactcttgtgatactacagattccaatatgtgaaaagttgatttggaatagataaaatgatagcacatgaagcaatattaattacttcaattctgtcattttgtatgatcacatggaatttttgtgtttaaaattgaaaatagctatatccttcacattaaaataatgttttaatcattttttgttttacaggaataaattaaaaaataattattactggttattgtgtgattcttattcaatcttattgtatagaccagaggatagcatgttaaaaaaatctattctgagtatctagtatgctaggtataccactaatccatcattttttaaaaacttcctccttgcatttatcctcacttaacatattctatatttggtttattgttcgtttattgtctgtctccccacgactaaaatatagggcccatgagaaggcactttgccttgtttacttttatgctctaaatagagccagaaataatgaccagcacatagttaagtgatcgatatatatatatactgaaggaaggaagggagggaaggagaaaggggaaaatacaggtaggtatcaggtcgtggaagggtttttatgccaggacagatcctttatctctgaggttaggaggagttgttgaaagatttcaagtggaagagtgatagaatcagatttgaaactaaaggaagaatgaatttgaaaaaacaaatcaggaagccaagataactgcttggaagctactgcagtggtaaagaaagtgagaggtggccgggcgcagtggctcacgcctgtaatcccagccctttgggaggccaaggtgggtagatcgcttgaggtcaggagttcaaaaccagcctggccaacatgatgaaatcccatctttattaaaaatacaaaaattagccaggcatggtggtgcatgcctgtagtcccagctacttgggaggcggaggcagaagaatcacttgaatcccggaggtggaggttgcagtgagccaagatctcgccactgcactccagacttggtgacagagccagactctttcaaaaaaaaaagaaagaaaaaagaaaagaaaaaaagaaaaaaaaaaggaaactgagaggtaaaggatatcagaggacatttttttagagtgttcataaagtggaattgccaggatattaaagagtagcccagataatccccattttggtgatgccatcctctgagatggtaaactcaggaagagaagcaacattgatcattgatatgaagtttatacggagatgtctaggatttgaatgtataaatctgttgcttagaatagagaaagaggtcagggcagatatggatttttaagaaatttgcatgtaggtgataattgaaaccatgagagtaaatgagattattctgaagactgcatggtgagaaaggagataaaaggacagaagacagaatttaataggaatgattattttccaagtttgttgtgcttaggaaaacaaacttttcttctatctgtgctcctgtaacaatctaaggctttgaaaaaaaaaaatttcttgtaatcgtaagtcctttagtatagtcagtggaaagtcagacaacatgaaaaaaatctttcttctattttcatgtttctttcatgtgatgaaatatatctataacaactttccgttctttttaaagcacaattctcatactctgacagaggtatgcttcagtttattactatagagataatagacttaaatttgtaatacatcacacattctcaaaatatttcctattgctataactagttcacctagacctcatttctctttattgtcaatcaacaagaaaaacaataggcctaatgaaaacaatataaaatttgaaagaggtaaagcaaagggcagcattggcctcactatcctaacaataacatcataatccttatatattaatttataagagaaaaatcagaatgtatatatgtacaaacattcttgaaaatctattagcactattttgtttatctttgttataatatcaagcccttttaaccctgttaaactcgtgtcctaaaaacagaagccactgttagaggaaagcaaaactactgattattttataaatttgttgcaacattaaaaataattgatgtgttcaatgcaatggagattaaatcctagatatttttcactgactccagtgatttcttaaaaagtggttgtgatactaattcaccagagataaaagaatctgtttggatgcaaaggagaaggaaagataaaacttgacattacctctttaagcaattgatttcaaatacaaagctaatttaatcttttttagccactttcaagatacaagagaatgagaggcagccgtaagtagaaaataaagtaacaggaaagttttgtggctataattccggctaaattccagcatcagtttttataatcctgtaacagtgacacagaatgcctgtaccatgggacagtacaaaggagattgattaaatatttcatattgtctctacatactgaaaagattcaaaggcaaaagaaagaatttaacaactttaaaagaaaaaccaccatgtttggtctggatccagagaactctgtctcactaaaaaaatgttcagcaaataaatttaaaaaaaacaagtttagtactaatttatatgaattacaaatgcctatcctgcatttgagttaaaaaagagataggctaacaacagtaatctaccaaaattggcaatacatagtaagttacaaatagggttggttccattttaggccttttgtgaaaatgcaatcaagtggcaaacagatttttcctagtttaccagggtacacaattaagttcatattttaaaaattgactcagatattcactgatgtgtataactgaaaacaacatacaatgcttatacatatattgttaatagattatgttttttctaattaataaagctgtggtaaataccattaaaatgatattctaaatctttccagagaaataatatataggacattttactttccagaaaaataaattcataaaatacatgtaatctcttggaattcatagtagtggaacatcagtacagaagaataattatttcttaacaatcaggttatttatgtttcatgcccacactaaagggtcttcctaaaatgtgatatttttgcttgatgattcagtcaaataagattatattaatgatagcttatacatcaatatttatgttaataaatatatcaacatatttatatcaatgatacaaataattgataattgataattttatattatcttgggcttagcatattgttgtttgagtaatattgaaatttatacatttattaacatatattcactggtgccaaaaaacataagaaacttcacaaattttagtaacaaatttgattaaatttatcctctgtgattattgggtatgattaatttatttgttacacatagggcagtagccacaacaaatttaaatgttaagcatagaaacagatattccaaatggatacattttgtaatccatgatttttttgataatatacatagagaaaataaaaatcaattgagtaatattattcagttaccatccaaattctttattttgtataaaatgttttaagcaatatctattccctaattgtaataaattttatttctttatgataatgaaatatgtgtcccgtatagagttctgtttattttcaatatatattcccatttccatgtataaattttcatgggaataatatgatcatgtgattttaaaaatgtatatttaaatacatttctagtacatgctgacaaaattttaatcaaaagtaagacttaagaaattttaaactgaaaatatgtaagacaacatatctatgtagacaacacaatgaatagtccaatattccatggatctaggttttccacatcactaatatccaggattttcagttatatctccattaaaagaaatattcacagggctaaaatcatttttcatatgattggttcttataatcaaaaaataatttgcagagatttctcttaaattcacagaactagagagaaaattttttaaataaatattgcttcaagccaactgcaaattttaaagtgaataatgtaatcaaaacttgaacatttggaaaaagaacatttaaaataccatctgtgagcctgaagttcctatatgattatgaaccaacaatattcataattgttttgctccatcatttctgacactataaacatgaaataaatgtaggcattaccttaaaccaccaacatattcttgtttttcaaatatagtgatgtcagagtaccccaatcgagccaaaaaggaagcacaacttatacttgcaggcccagcaccaaaaagagcaatctttgcagaataggcttcagacattttttctgggggaggcagcgaaggatttctgatctgtgggatactcattgctttgaatacctacggggaaatcaattgtcatggttaaaattttgaaactagcttacatcctcaaacatatttttaatgtttcaaacgaattcttgttttaaatagcaatgagcagtacattttcagtattaatatggtatacttacaacttttattgtgtcaagtagatgaggagttatggctaactttcagtctttcctttctagagtcatgcctcctctaggaaacactcatggggcacattccctactcccacctagagggtacattaagtgcctctcctctaagctcctacagcataatctgtatgtctctaacataaccatctgtggtatgtgttatgatgtcagtcagtagaatgaatgttagttccctgaatcagaaaacatgtcacatgtaaacacattacccttgcattataggagttagcattgcgatggcacacggtagacatttaataaataatttcttgaattctgcttttgattatgacagattaactttgggagaataatgatttaaaaaaatagttgaaacattcaagaactactgacgcaggcatcttggaagggctaacatctcagaggaaagtaagaacaaagttaagtgaccagaagtcacttttcccctgagggatttgcgacttcttaccaaagggaggaaggctaagcatcttgaagagaaccacagctcagaaaagagatgttggcagtcttttgaaaccagagagacacagagttttggaaatgtaggaggccattaacctagagcaaaataaagtacagaagagtgagattaattcttaaagtgcatatgacaaaaacctaaagatctaaacagaaaaccctatggtccaggaaaaacaaaaactggagtgactaaataagaaagagccctagtacacacctcagtgtacggctgaagcttctggagggctacactctacaagtagggcaaatgaggggtaaatagccaacctagccttgagtcaactcagccctggatttaaatgacagtgatcagtcctcactgttatctatgtaccaaacgatagaatgcactttctgtgaataataagtcaaccacagtttctacaaattttttataaaatgcctgggtttttatttttaaaagtccaagcctgcaagaaaaataaacctaaaaaaattgaaagagatacatacataatctcgtaagtgtggttatcaaaaataaattttagaataactatgattgatatgttcaaaaatatgtaagaagaatgtaaacttcattaaaagctggaatttgttaaaaataaaaaattaaatttactaagtacatttagtaaaacatatttagcaaaaaaaataactagctaatgtggaaggagggagtgggattttaaaaacacattattaaaatgtattaattaaaattattataaataggtggtagagggtaggaaacaaagaaacaaatggtaagatggtaaatataaatgtcaacatgagaaattatattaaatgtaaatggactaaaattccaattaaaagacaaaagttatggaagataaatgccttaaatataagagcacagatagataagtgtaaagttaaagactagaaaaagttatacaaagcaaacactaaccaaaagaaagctggtacatatatatattatatatatatatgaaatatatatataccaatattagaaatattacactttaaggcaagatgcattactaaacttaaagaacatttcatagcaaggaaatggtcaatctttcaacaagattttaaaatacaattttaaatatataaagcaaaattgatagaactaaaagtaaaataaataaatcactataatctcattattctactctcatgaaaacttgactaccaatagaagtggccaatgaataaatccatattataggtaagttatttatgctatccaatggattggctcacacagttgcttgcatttaataggtcaaagcagtaactttctctcctggaaacccagacagagatcaatagatataaatgtaagttttcttaagaatgaggaataaaggtgacaggactttacattttcttaacctcatcccacatataccacaaactattgtaaataaagtcaaaacacataaggaacatccaaacaatcttattttaaaaaattgaagagggtattatcaacaagtattatagggtcaatttctaagcatgagatgaaaggtcctcataaatggtctcataatattttgtcattttcattctaatactttgtcacttttactggtttacttatctgtttcctctcttagaccataaaatatttaagggaagacaacatctttgaattcaccttttaatattcagtgtttttatacataagggggaatatatgttaactaatgagtttaaattggtaataaaataatttcttattcccagctacaatttgtataatttacaaattattaatatgtgttcctgctcttccctgtgctatccaaacagtacagattttcttaaatattgtttttgaatcaacatatactgttatcttttattcctttctaagcaatgtgaacaaggaactaaattctggtagttttatatgatcattaattaaaatgtagttaaaatatattttatatttccccaaagaaaggtttcacatacttttcataaatatatattttattagatcattaattaaaatatagttaaaatatattttttatatttccccaaagaaagatttcacatacttttcataaagagatacttaaaacatatgtttaacgtgatcaaggatctctgatcagggaacagagatatagctaattttatttagggattaaataaatgctaatttctttcatatttagttgaataattttagctttgtgaactaataattaaatatttaactttcccatgttaaaatctgctaacatttacaaataacattgtgttttaacaaatcttaaatgaagacatttatgatgtatttaaaagtatcatttattgctgacatcttttacaatggaagcagatttaaatgtactaaggctacagcattcattataatatgaagttacagtgtcataaccaaatggaatataatttgtgctcagcattcactcataagcaagaaataggttagttctgaaacgcctagcatatctgaacaaattctagctaatggcatgcaaataataaagtagcaattaccaaataatacacaatatgtatgtattttcacctaaaatattttaatatttttgaataaaaatttaagccttcttttaaaaaaattatgagatgcaaacattgaattattttaaaaaatgtttacagaatccctattaagtacccaacacagagttaaagactcttaaaaagtgtttgaagaaatgaaagcaagcacactcctcagtacacatagcatatgtgcacatactagaatgtaaattgttagcccgatttgctcaaccccgtgcactgcagcttaagagttgttcaatacatactcattacattgcttggctcaatacactaatctatcaattggtatccctttgcctgctctgttctggaattttttctttacaactttttattgcactaggttttccccgagtttaacaggagtttggattaaccttgatgcaatttttaaggaagtaaataattgaaccacatttttgtgaatttcagcacaacagatggtatatttttagaagtatggcattgaaacgagactcttggggttgagtcttgacttccatcattctcatgatgtatagaattgaacaagtcctttaacatttctatgcctcagtctccttaataaggtgggattaataaaatatatttcatagagatgctttgaggatttaatgagctaattatatgtggaaagtgctttaggaaactgcctgcccatatagcaaatgttatctacttctcatttcacctagtgttcaaattccatgagacagaatgtatctaaactcatagtgtccaagacggaatccactagccacatttgattaagttcaaattaaaattaaaattaaataaaattaaaaatgcaaagacctcagtagcactaattatatttcaagtgctcaataactacatgtggctagtggataatacatcgaacacatccatcactgcaaaaattaaaatttcaaacatataatgcaatagatataaataatctcatgagcatagttaatgggaaataaataatttagaggcagtgagtttgtagtatttgttatagttatttttaatatgatttttatgactacatgttcatatactttaatttttcaaaattactgtgtttcacaacctgtttacaaaattcctaaaaatttaatcagcactagagctggtcctggctggcttcagcacactattgcacctcggcaatacatgagggctcattcaatgtttttttagccactaatattcttctaccatcaaccctaaattctgaaatacataagttacactttccaacttaatagagatctgaaggcataagtggccctctatccctttaaaacatcagcaactaactcttttttaactgaaatacaagtaatggattatttcatatatacacaatatacttccatgaatgtagcctgattatgacaaaatgagggcaaatggataaaaagccaaataaatagctccaaaaatattttgtgggtgaatggggggtagtgatttgtatttaagtatattatgaaactatgaaaattgaaatcaattataaatctagagttggcattatatgaaaaatgtaaattaaaataactaatattgtaacactttaaactgccaatgaatagattgtgtaagttaaaaaaaagagggttaacttaattttgttaaatttaaaaataaaagtttacaaaagttagttaaaacaaattacaaaatttaaaatgtccataaatacgaagaatatttttcaaaaataatatttttcattccttttattaaactacatcagtcttcagagaagtgcaacataaaattacaaacaaattatacataaaagatattattaggtccagttacttacagtatcaaattcctaagagattttttcttagaatatagttccctattgtttcataatgtaacaaaaatattataaaataatttggctctttcggtgagaaagacccctctttttttcgttaaagcaaatgtcagttgtccatcaactgactaatattctatgatttaatttttaagttgaagggtcaactgccgaaacaatgtaataaatgaaataaacttgttaatatcagaagagagtgactgaagtatttaaagatgaatgaaaagtatacttaatatgtatttccccacaataataaggtggccaatatttattgaaatatatcctatgtgccaggctttatgttaaatctctatcatttagtcttcaaccctcctttatggaggtacaattatcagatccatttcctaggtaagaaacctgtggtcaggttcacatacaaaagattttatcttaaggctacttgactccaaagcctgaactctttttttttttaaattatactttaagttttaaggtacatgtgcacaacgtgcaggtttgttacatatgtatacatgtgccatgttggtgtgctgcacccattaactcgtcatctagcattaggtatatctcctaatgctatccctccccgctccccccaaccaacaacagtccccggtgtgtggtgttccccttcctgtgtccatgtgttctcattgttcaattcccacctatgagtgagaacatgcagtgtttggtttttttgtccttgcgatagtttgctgaaaatgatggttttcagcttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttataatcctttgggtatatacccagtaatgggatggctgggtcaaatggtatttccagttctagatccctgaggaatcgccacaccgacttccacaatggttgaactagtttacagtcccaccaacagtgtaaaagtgttcctatttgtccacatcttctccagcacctgttgtttcctgactttttaatgatcgccattctaactggtgtgagatggtatctcattgtggttttgatttgcatttctctgatggccagtgatgatgagcattttttcatgtgttttttggccgcataaatgtcttcttttgagaagtgtctgttcatatccttcgcccactttttgatgggttttttttcttgtaaatttgttttttaacgattacattttcacagtaatcgctaaaaaattcactatatttctctaatttttcaataagaaatgtataactgaaaaaattatatgaatttgtcattcctaacccacttagaatatgttatattttaatatattaaattcatacattctgataaaatagattttgatatattctagccactctactaacaaaaatagctggttattataattaataaattaactttacaaaccaagaattgttcatgaagcatttaaaaaacactgaactacatcatctggtttcccaccatgctatcctgccacccgagaactaaggtagttggtgcattaagagaactgcctccctattatcaacatcctctccatagtggtacatttgagtacatttattacaactggtgcaccttcaatgggtttgcacaaatttattatgaaaatagcatcataggactacagcatcatacacaatagtttctttcactgtcctaaaaatcttcttaatctccatatgcatccctctctcaccttctccccagcaatcactggtctttttagtgcctccatagttttgccttttctagaatgccatacagttgaaatcatacaatatacagccttttcagattggcttctttcatttagtaacatatatttaagttttctctgtgtctctccatggcttgatagctcctctctttttaatcctgaataatattgcaatatctgtatgtaccatagtttatttatgcatccacttactgaaggatatctcaaaaattttggtgattatgaataaagctgctataaatatccatgtgcaggtttgcatgttaacgtaagttttcaactctttggggtaaattgccagatcatatgataagagtatgtttaattttgcaagatactgtcaaactgtcttccaaattggctgtaccattttgcatttccaccagggaagaataaagttcctatttctcctaatcctgtcagcatttggtgatatcagtgttctgcattttggctgtttggtctcctctgaatgtttgtgtctacgcccccatttcattcaattcgtatgttgaaaactaaccacaaatgttagaaaggtggggtttttaaaaagtcattaggtcatgacttaggaggtgattaggtcatgaggagccctcctcaattagattagttcccttaaaaacaaccccaggagaaataccttgcccctgtcacatgtaagacaggcacagtaaaaagcctttacctatgaccagaaagcagcttatgagcatatattttttttattatactttaagttttagggtacatgtgcacattgtgcaggtcagttacatacgtatacatgtgccgtgctggtgcgctgcacccactaactcgtcatctagcattaggtatatctcccagtgctatccctcccccctccccccaccccacaacagtccccagagtgtgatattccccttcctgtgtccatgtgatctcattgttcaattcccacctatgagtgagaatatgcggtgtttggttttttgttcttgcgatagtttactgagaatgatgatttccaatttcatccatgggaattcccagcatccagaaccaagagaaataatttttgttgtttataagccatccagtttatggtattttgttgtagcaaactgagcagactaagcattctaatagtatagtggtatcccgttgttgtttcatgttgcatttccctgatgatacatatgaggcatctattcagatgcttattttccatctgtatatctttcttggtgagatatctgctaaggtctttgtatcattttttaaatgggttgttttcatattgttgggttgtaagagacttttggacattttgcataacagttctttatgaagtatgtcttttgcaaatattttctcccagcctgtggcttgtcttttcattttctttcaagacagtttcctgcagagtagaagttttaattttgtttctgtgtttgttttgagatgagagtctcactatgctccccaggctggtctcaaactcctgcattcaagcaaacctccctcagccttctgagtagccaggactacaggtacatgccaccacacccagctcagaattttttatatttgatgaagtctatcttatcaataatttattttataaatcttgcctttgattttgtacctaaaaagtcattgtctaaccgaaggtcatctacatggtctcccatgttatcttcaaagagttctgtagttttgtattttacattgaggtttatgatccatctttaattaatttttaatgggtgtaaggtttgtttctagattcacttttttacatatggaagtagggtggtataaatatcattcgttgaaaggactatcccttctccattatattgcctttgctcttttgtcaaagataagttggctatatttacgtgtgtctatttctgggctctctattctgttccagtgatctattgtctattattttaacaatatcacactgtcttgattactgcagctttacagtaagtcttaaaatcaggtagtccgagtcctccaactttgttgttctatattatgttggttaatcttttgcctctctatataaactttagaatcagtttgtcaatatctataaaatagtttcctgagattttgatttgggattgtactgaatctatagatctaattgggaagacctgacatcttgaaaatactaagtcttctatttggaaacccggaatatgtctctatttatttagctttttttatttatttcatcacagtttcatagtttttctcatatacatattatacctatttcattagatttatatctaagtatttcgtttttaaggatgcaaatgtaaatggtatacttttaatttcaaattctaatcatttattgctattgtaaaggaaagtggctgacttttgtttattaatcttatatccttttttgccaaaattgtgtattagttccaggagtttttctgttgattctttggaattttctacatagacaattctgccacctgctaacaaagacagttttatttcttccttctctgtatacatttcctttccttttcttgtcttataaattgcatttgtattctttttaaggtgttcccttccctacaaatattgtatcacttggactattttaagattattttaataggcactcaacaagattttgatgaatttcaaaattcctggccttcagtgatatgcttaaacaaagtagtaaaagtcaccaaggaaaacagttctaccttagtgataatgaagaattatctgcaagtgaatatccttttttaaattttactttttaatatttttactttgtaagtacatggtatatatttttttaattttactttttaaattttttaatattgtgggtacatagtacattcttgaggaacatttttaatattaattttcttgtgtattcatcctgtgatttctcatctttcattcatctagaaagtgcatgtatttcaccactccaaattgactttaccagcattttctccataattttcacattactttgaagaaagggagagattatattgatatttaaaatggaaagattgcaatgcagagaggagccacaggattttcccccaagtctcctcaccttctggagacagaaatagtataattttctaatcattatatagtgttctataaatgaaaaaagacaaagcattgtaaataaaagtatatttaccaattcaaatttgagggtaactcttgcttgttttaacccttcttgctaagagtatataatgaaaataaacataaatgtttgatagctgtaattattcctcaattactctgtttgttctaattaaccaaacaatagcaaatatataccatagggaagtcatgagaagtaaaatactcttggaaattttagaacatctctactagttgaaggatgaattgtaacagtatgattgtattctacatacctcacaagaggattatactcttgcaagtgtttaccttgatttcattatcaaataaaaataatttctggtaatttctaaaggaatgttatttcatcagtgtaggtctaagataaatcttaataaaaataatacatcagtttttcttttgctcgtttcagtttcttgagttacttaattagtgggatgaatgtctcgttaccttttgaatgcctgaatgaagaaattgctatttgtgcatccaaaagtaagtttcctgaaattacataccttctaggagatgcttctatgtaattttctttgttgtttgtttccttttgtaagacaagtcaaaggaaatactgagtacatactaatcactgcattcattctttgaaaagaaatatacttgggcttcttgacaaatagttttcttcataacaattagaccaggaacaccaaaagtgagtactgtgtttcaaatgtattaaaaatgataaaaacttcatgtaatgtcaaatttttatttatcaaaattattactgtattagtaattctcaaagatttttttccataattttcatattattaaaatagacattgagagaaacaactggcaggttaaaaatactgtgttagctgaaatcagaatattctttcattcaatttccttttcaatttggtaggtattgtttaggtacctcctatgtcctagacaccagtatgaaaaaaaacatagactctccagtaactagctccctggataatagagcactcacatgtcctaaatatttttaataaactatattactatgtagcctgtctggaacagggttaattttcacaaacgttgctctcagagtatttgagaaggtaaacccacctgaaagagaaattgacacctaagccaaaccttaaaaacaacaataaaaaaaacatatatatattagacagtacttcacctttttaaataccaacactgaaaattaaaagagtaatgattacttcagcaatttattgtgaagattagagtcaatggtgataacttcttgtgatgaatgccttttccttacaaggcactctctggggaacttaatatttatatctccaatcctaaaaatcttcgactttaggtatgattgttcattttctatacaaaggaactgactcataagattatagtctgtgttattatgactaaacaaaggttatattggatatttgataaaccaattgaatagagtggttaaaactgaccaaatatagatgaaaacgttaagtgtttatagtttagttataagaaacttatccaaaatcatatgctcaggacacttacattagcccacagataggcaaaataatctaccacaaagcctgttataagataaagtactgaatatttcatgtaatttatcgcatacagtactgaaagttaaaaataaagtaggtgaatgagtatttgaagtaagttttctactaaatgtgcatcacttttacaccattttaaagtcaaaaaatcctaagttgaatcattgtaagtcagggactataagtcactgttttttagtacatggtcagttttgataaatgttctgcaagtgcatgaaaatgatgcattcgttctatgttaggctcagaaaagtatagatttcttaaatcaatccaataaactttatacaaataaaccttacaaattttgagtaaatttatgttgtcatgtgtataaatgtttatgaatattacatcttttaagagttttttattattatttttatcttccaaaacacgtccttgtcaatattataaaacttttttttacatctttatttttaaaactcaaaataagttataattactctgggatcaatatttaattatattcacaaccatatttttacacattgtttcttttatctttctttccacatttgtttccttccttctaaagaataactcttagtagatgcagatgagaaatctaaggtcagagtaattgtcatttggttttccagtaatttgttttccctttatcttgaagttctgattctcattatccttagtattgcacaatattaccacaaccctgtgtctaggtgaagacctttcatctttcctttcttctggaaaattttccaccataactgctttaaggctcctcctgtgccaatctctgtctctctactttaggagctccccttacatgtgtattggagtcttagaagcttctgaacttctctattaaacttttcatttattcgtatctctttattgtgctctggttgaatactcagatcatatttttactttttatttctttagttctgcaatttatgcctctatccagcccaaaactgaccttttctattgagattgtcattatagtgtaaatttacagtcaactattttttatattaaactcaccgttgatttttttattttatctccttttaggatattattttatacatattaattttaaaggcctgattataatattatttgtgtttcattaggataaagtcaggtaccatcaggtaagtctttaaattatcactaatagattatctttcctaacatagtttctacctttttgtttctcatttacgttgagtgaattttattctctttcggggcactccccctatggctttgtatcaggtgtgtgtggccttcaatcaacaatactcctatccctctctcccactgcagaaccaagtttcttaaagtccagggctccagtccaaggtgattagaggcatcacagaaccaaatcactgtaccatagacacatgcccacaatacctgctgtacagctttctctacttttttctgcagctttctataagcctcagctctgtacagcagttgcacctattttttattaaactttctatgaggtggagctgagtccagtcctctaccatgcaagatgtttttggcacttaagtttatcttagaccactccccagcagaagttagcagagaataacctagtccccatgtttttataccatttctggcccaaaaggtatttatatttctttttcagttcacctcttaattttttttctactttcattaaattttacttatcatcattatttgaagataaatgggtggcttaaatgttaacttacagcatcatgccttttacaagtgattcatgttgatacaataatattgctttatactaccctatattatgagtcatcaaatatttttatgaaagtatatacatttttaagttgttgaagcttaaaccaacgaatcctttaaaactgtaaattggcaacgaaatagtataaatttacatttatttttaaaaactaatgtagaaaaaagtaaccgcaaataattttaaccatgcgatttcgttaaatttcaaagttattgcccccaaatcacggtagcttatttttaagtcctagatattaagatacagttttaaaacaaactaaaatattgtaataaaaatcatctagcaattcatctggccccacagttctattataaatcattgtgccagtaaggaatattttaatagatttctaaagatttttggagaagaatgtcagatatttagtgaattctatcaagacattattcttttctattaatcactgcattaagagtaaaaggagagacacaaatcaaatcttcaaagatgttacttgtatttgcattccagacagacacattttaccagggtaaaaaatatttatcttattagtgcttaatgcatatttttcatctatatcttacttctctcagaaataattcacctttgtgtttgagggttgggtattggttaaagacattcacaaataattgaatagtactattttaaatagaagtagtatagagaaatcccatttaaagtgataaaactttgggataatagggcaagtgtgatatatcattaatctaacaaatatagtttaatctatatcctatttataaatgacctgcaaaaagttattagctatatatattagtaatttttcattatcatgataatttatcttagttatagattacaaaatgaactgatagattttattgatcagtttgtcaaactgtatcataaatgtgctaggtttattcctaaatttatttgtataccagctttcacaaaatcatacttaggcattccaaaataaaataaaactgcagataaacacttaacgcttcaaggctcctcgtcacatagaccccccctttttatttatttattttttgagatggagtctcgctctgtcgccaggctggtgtgtagtggcgcaatctcggctcattgcaacctctgcctccaggttcaagtgattctcctgcctcagcctcttgagtagctgggactaaaggtgcacaccaccacagctggctaattttttttatttttagtagagatggggttttaccatgttggccaagatggtcttgatttgaccttgtgatccgcctgcctcggcctcccaaaatgctaggattaaaggcatgacccaccacgcctggcccatatagaccccttctaaggccttgtatttaaatttttcagtagtgctgtaatgtaatttctaaagaaggaacccaacattttgttatctgaagccccataaaacttaagattcattcctggctacagaagttaaaaaagaaaagacaaaaaaaaaaaaaaaaaaacaactaagccgtatgtgttggtcttacccaacctatttcaatgtagtagcttcatatctaacagaaaaacaaggacttgtgaggtatggtgaccaagtatatttggctagcctagaagatgcaacagatactgctgtggccttacagccagaaaaccagggtttacattgagcgcctctgtctttgactagtaacattacctggggcaagtaagagtttgtgaaataatgaaaattaaaccactagctttgtattccagatttgcctctcactacatgtgaggttgtggaagttaattaatttcctggagtttcctgttactcatatgtaaaatggaaataataacattatttggagagttattctgaggattaatcaagctctaaataaagtactcaacattgtgcaggacactgggagtttatttaacattagctgtgattttgtaatcactttgattcttagtttccttatgtccaaaatgggaaaaaaattacctggtttgcatgccctcaagcgttgtttatcagcatttttgagtgagatattacaaaaatgcactgaagcactatgcaaagtacaatataactgcattttctccttgcctgatacttttctttgcactaaggtctaatcacctccaaaaccatgtgacaaaaattaatgaagattggacaataagtccaaggatgccaatgtaaacctatatgtctcattacatttactacattatttcaattgttggctttatttcctgagaaactacaatgttccctaggacttgtagtaaagaagcagtctacaacaacacacagtgctgatcaatgcccaatcaatgttagtttgattaactgaatccttacctagtgggctcttactacactgggtattcacataagccagtttgcctggggtggtgttagtttactcctgctgtactggactgattattaataatgtcctgatcattatctaacctatctcggtcatttgatcatcttacttataaagcaatcaacataatacacagctagagtatttccaacctcacttttcagtttatgcacaaatactcatctttttgatgactgtttttaatacggggcttgcacttaatatttctgtctccactcttctatttgatagatgaaatttatcacagaaatacattatttcagagcacacctgcaatactctattgttcattagaatacatatgtctatgttctcctaaaatagagttgtagaatacaaaagtttaagaatttcagtgactgccataaccaaggtgaagatatggtagaagtaatatttgctctattaaaacaatcatatactaatttgagtgaacaagttccttctccattcccaattcttcaaaactgtttattatcgtttttaagcaaaacataaatgttgatgtaatttaaataattgttaaatgttctctaatgtagtctcataacacttgacatttttaattgtattagtgtatatttaccagactaatttaactcaaactgtgtctacccttgataaaatatagaaataaatgtttacagtcccttggaatatatagtatattctttctttaacccttaagaaatatcccatcatcatgttattaaggcataagaatagttaacaaaattctgaaaatggtaaatcaagaataaaacaccccatcatatataaaaatataaaactgtagcaattaatacattttgtgtcagtgaatggatgcataaatagaccaatgtaaaaaaaatagagctccaaaccctgccaaaaaaacaaaagcagacaaattcatacatatgatcttactgtataaaatcagagttattacaaatcagtgtggaaacaacaaactacacaataaatggaattgagttaactggctttctgtagagaatccagggtgggtgtgttatatccctagatccctccatcaccacacatatgacacaatgtacaaagaataaactttttaaaaaaagatgaggaagatgaatggtcaataaacagatgagaaagtttctaaacttcaacattcatttgagaattccacattctttgtacaattatttcttaggaaacataaaacatagaccatattcatcaatgaatcagagtgcttgacttgggaagggaatatcatggcctttagcattttatctataatatatgttcaatctaaagcaaataaaacaaaatacattttatcaattacatgaaaaaattcaattttttattttttatttttaattattattaatacatattagtgtcaaatgtgtatggtgtacatgtgatgttttgatagatgcatacaatgtgtaatgatcaagtcagggtaacttgagatatccaacacttcaagcatttgtcatttatttgtgttaatgaaaaatccaattcaattccagatagttaatgggtatgaaaatacacttacatggaataagatctactgttcagtagcacaatagtgtaactgtagttaattatttattgtatatttcaaagtatttattgcattactgcaaatagtatatgctgatacgacaaggattgagtaaagtcaaatgagaggtgatagtttagaaacctgctgagagacaaaaagtaaaataaaaaaaatgtttaaaaacataaaaaaggaaaatctacagatacctcttttctgaatgagtcacctgatttcatctacaattgcttgtcagttccattctcttttttggcttaaaaccacagaaatttcttacatttttaaatatttcaatagtttttggggaacaggtgactttttgttacactggtaagttctttagtagtgatttctgagactttggtgcacccatcacccaagtagtgtacactgtacccaatgggttgtctcatccctcatcctcccacccaccatttctcttccccctaagtccacaaagtctattgtatcattcttatgcttttgtgtcctcacaagtcagctcccacttatgagtgagaacatatgatgtttggcttccattcctgagttacttcatttagaaaaatggtctccaactccatctacattgcagcgaatgccattattttgctcctttttatggctgagtagtattccatggtgtgtgtgtgcatgtgtgtgtgtgtgtgtttgtatcacattttcattatccaaccattgactgatgtgtatttgggctggtttcacatttttgcaattgtgaattgtgttgctataaacatgtgtgatcaagtatctttttcatataatgacttcttttcctctgggtagatacgcagtagtaggattgctggatccaacgttagatcaacttttagtgctttaagaaatttccacactgttttccatagtggttgtactagtttacttcccaccagcaatgtgaaagtattcccttttcaacacatccatgccaacatctattattttttgatttttaaattatgatcgttcttgcaggagtaaggtggtagtgcattctggttttaatttgcatttccctgatgactggtgatgttgagtattttttcacatttttggtggccatttgtatatcttattttgagaattgtctatttgtgtccttagcctactttttgatgggattttttttttctcgctgatttgtttgagtttcttgtagattctgggtattagtacaataaaagtataaaatctaaatataagtaaagtgctaagaggtatatatcataagatggtatatttcacagatatcagaaaaatcttataaaatgtttttgtgaaataaattttatatttagatgtcaatatcataatccagtatattcctgaaaattcagaattgaggtggtaattttaagtataaattttccagctctcattcattttgacacacaaatcctggaagactgggattttttaattttaatatttctaaattgcctccataattttttaatcagtagaagagaactgatttgacatgcagctaattttctatgtaaaatcgttttttttcaaactttaggcaatgggtagaaagatgcattctcatttccttctgcttttccaacaattcattaattaaatttcagaggcaatgagagtctaggtggtctattaaatgtaaataatatataattctttcaaaattccaataaatacacaaatattttcaaaataaaattttcaagggttatatttgtgcagagaaattcaaaaaccatcatgtgactgataaaatctatactaaactattatttcccagttattttattgaaacaatgtcatgataggattaaaatattactagggaaaaaaagtgcctcctagagtgagtcacaatcaccccggtagcctgtttactacatgaacacaccagtgtgtgaaggaaggtggctttttcacactgcaaatgtggaaacagcaaaaggctgaataggaatgacaacacaagatccacccccaaccctgccaaaaaaaaaaaaaaaaaaaaaaaagcagctggcctcctgattctacataaggctatgcatcatgtgatttattccttttccactatggtccctccaaatcacatgctcatgttaaactggagaagaataaggtatgtacctaaccaataatggcagactactgagttggtattttaaaaatcacttataagtcacaggaaaaacaattttgaaaaataccatactattgtaatctgctttcctaacctttgcttaatttggttgaaaaaatagatttgtatttctttaaaggtcaaaaaacaatcattgttttatcaaacaatcaaaatataaaattatttgcatcatattacacttcaacttaaatactcatgtcaatagtagtttgaaagaataacatttcgcattttgtacttttttccgtgaatatcagtgaaaacggagttactcgttttgttgtttttttaacttcctaataactttgacagttgggtaaatttaagtaaaccacacactgacctagggaatacaggactttctaaaatcaggcaccctaatcggccaacccaaaaaaaaggacaaaaagcttttctcagtagttcccacgaggacatttttaatttataatttgatattgaaattacaattatacaaactataattggaatgaaataagcagatacattcctattctaaattccttgattcacttaaaatgcatctactgcagtcctaatctatgcataactcttcattaggtgatacttatggcaagacctaagtgtgaccactctcaaattttagtaagtttctaataaattctgttctgaaggcacatgtctctgtcttaaatagactctgctctgggaatgagtggtagaaccaagtaagagttcccagagggacagtgttcccagagaaaagaattaaaaccatgtgagagtttccagaggaataatgtatttccctgtctctctctctctttctctctctctctctcacacacacacacacacacacacaaacacacacacctctcatgaccagatcaattactaatgatatcattttaattcattttgttttaaaatgctgtgttagttgatatacatactatgtgacctttcacttactgcatctgtgaaagcttgccctggtttaatgaagaggcaatgggtccccaaagaaaagtgaggaggaattcaagtgaatcttctccatcaactaaggattttcacaggtagtaaagatcatacttcgtagtggtcaggtaagcctaatgcaattttgaatttggtaagaaaagaaattaaatcccagaatttattgcaacaatccacaacctcgaattgtttttattttcttattcccaggagctcttctttagaattaacctgtcagaaagcaggaagggaataaccctgatttattactaagagcaaagtgagacttaagcttgaggaatattatgggaagggtcccaaaatgaaagaacacattgtgtttatgctgacaaaaccagatcagtaagtcattaactaaaaatctaggttgacgggcacttaatttgaccttctagccaactagtctccaaagattataaaatcttactatacccttcatataagctgatcatttaaatgatacatgggaattaacctgcttgttgactccaaataggagacgtcagagagcccaagagtgtctgaagaatcaaagtctttacaaatgattcattaaagagaaagccaggatcaaagtctatgggataaacagaaaaaaaagtgctctcattttatttccttatacattttttacccaaataaaagacctgcttccaatctataagttcacaaaatctaatgacattattaatgtggttaaataacattacttagtttcagggtttttgaaaattctctaacattattactcaaagaatacaatgaaatatgctgtatttcaagctttaaagattaaggagagcttcagggaaaataatctgttacagaagatagtcttttcataagagggtctccttgccatacttccacataaagttaatgaataagttctattttcggatcatctaatttatataatttcagtcaaagtattttaataacctgctgggattgcaactaatttgacatatggttttatacacttcctttttgtagctaagctgctgaataaaaataaagtttgttgtacaaaacatacttgagctgtgtgtcacactaaaaatgttgggtatcaacagagcaccaaggattaaagttattttaagatatttgtgcatggtgatggtagtggggggatgtcacgtgtatatcatacatacctcagtagcaaattgctgcaatccaccaatattaatgggtccctcttcagtggcatataaattgcatccacctacacaaagatcagaggttggacataccattccacaagtcagaccaagtgggttgtcagaaaatatcatcttagcagctccataatagttctgcaaaattaatacaaaataaaattttactacttaaaaatatactttaaacagccaaattacgacaaacattatttcttctactaggtaatcagattgaagataatgatgtgtataagatgcataggtttcaatactactatcaggaaccatcaattaaaacttagcagagtatttgacacataggaatattcaatgcacagtatgttgataaatgaataactaatcaattttggaaaactgaagtttaaaatataataaatgttctgtaaatggttttcatttacaagtcatctaactatatcttgtcaaaaattattcatttcactttttaacaaatgaaaattagatggcattgtttgaacaaactcaaaacctaaactttaaaacaacaaaaaatggttatactcaggttatcctccatttaactaaattaaaagcagccagagctttcattatttttggaacatattattttctgaaaaaagaatgaataataagctgaatatttgggagaatgttttcctctaatcaaaaggaagaattgcatctgaccagtactcctgaaaacaatcaagtacatcaaaaacaagaaaagtctggcaaattttaacagacaagagaagcctaaggacacatgacaaataaatgtattgtggtgatttttatgatatactggaacagaaaaaaaagtaaaaattaagaaaatctgaataaactagggactttagctaataatcatatatcaatattatttcattaactgcaacaaatgtaccatactaatgtagggtgttaataataggggtaattatgagtgcatatggaaactctctgtactactgtcacaatttttccataaatctaaaactgctctaaaatacattttaagaatagagctgatagaatgcacttaacaatataaacatattgcatttatttttcctttggcttttatttgtaataattttgaaggtctttgaaagcacagacgttgcttccatgaaaagcctcagacataagtacagattcctagtgattacagaatactgatgataacaaaaaggaacaatgacatttactatttattgactctttaatatatccccagcactttaaaagacttttatttactcttagcaccaattattttatttactgttatcatctctcactatataggatgtccattgctcgatcaaaaattcctagatgcaagaagagacaggaccaaacgcctgataataataagaaaacaataaataaaataagcaaactcctaggtaatcaagaaatttaagtcagaataaaagacttttaaaaataaccttgacgaaaattcaggaaaagaaaagacaaaaaaagaaacaattaataatagcaccagaatactggaatctgtttaaaaagaatcaaactgatattttagaagtaaatgaacattttaaaataaaagctaatgcacggctttcacagcattcgtggtggtttaacagtatttgtcttgttcagtgtcccttcagcaatgaaagttatgtctgccatgtaagaatggttcttctacatatattttctgaatatgcagtaagaatgtggtatgaaattaaactcacaagcaataaaactgaaatataaagggtaaataattagcaaaggatcataaagcagataagtggcagagacaggattcatactaaagcatactgttcatggctcaatagattacagaatctagttacagtgatcttattcagctatggtccatatgttgatgtaaacacacacacacacatgcatacacacacacacaaaagttcttttcaatataagctggaggacatatagctagtccattcgattcattacactttatattaagtagtttttattacatagttcttttagttgtggtctttccatcagttcaatgaaaagcttaataagttaaaagtctgtttcttttaatcaagagattaggatctgtttattcccccaaattggatcagatttaccactgtgtttgtcagagtcttcggtagtgtctctaaaagaggttaataataaatcattaagctgtcaaagtataatatccaaaagtcaacacagaaatatcttacacacagagaagaaaaatgtgtgaaagattatatttacctcattaacaaatacagaataaagatagtaaaatctgagtcaagggcatttgaggctgccatggcttaatcggtgaattgtataaaacatataataacaatttatgctaatttctgacaaatacttctagaacatacaagaaggatttatctcaggaatgcaaggttggtttatatcaaaatataccatatcagtagaataaaagacaaaaaatcacacaatcatattaaaagatgcagaaaaggcacttgacaaattcaacatccctcatgacaaaagctatcaacaaactgcaaatagaaagaaacttcaacaccttaataaaaggcctctacaaaaacccacagttaacatctcactttatggtgaaaactgaatgccttcctccaatatcaagaaaagaatgttcactgcattagtcaaggagtcaaaagttctccagagacacagaaagaataggatgtatgtgggggggggggggggtgtgtgtgtgtgtgtgtgtgtgtgtgtgtgtgtgtgtgtgtgtgtgtgtgtgtgtgtatgagatttattataggaaactggtacacaattaagaacctgcaaatttccaagatctgcaatttgagtctgccagctggagacacagaagagccaatgttttagttcaagtctcagttggaaggcctgagaaccagttaagttttagttttagttctagtccaagagtaggggagaaagccaatgtttcatttcaaaggtagtcagacaggaagaattatgtgtttttcagggtagagctagcattttgttttattcagtcctttaactgattagatgaggctcacctacacttgggagggctatctgctttactaaccttactgatttaaatgccaatctaattcaaaaacactctcacagaaacatccaagataaaatttaaccaaatacttgagcacacaaaggttcaatcaatcggacacataaaatcagccatcacactaacttttacaacttctattcaccatagcacttgaaattcttgctagataattaggcataaaaggaaggaggaagtgacagagtggggagggatagagatagagaagaagagagagagagggagagagggagggagggaaggaaagagagagagagagagagagagagagagagagaaagttatccagattggaaagggaaaaattatttctatttccatgtaaaatgatcttgtatatacaaaccctaactaatccactaaaatactatgagaagtaataaaagtacagcaaacttacaggatacaagattaaaatgcaaattaattgtatttcaatatgttagtaatgaacaaacgaaaaataaaatcaagacagtaattccatttacaacagcaacaaacaaaataaattattcagaactatatgtattaaaaactgtaaaaagttcaaatttatactctgaaaactatagaaaactgttgaaaggaactaaataatacctaaataaatgaaaatacatcccatgatcatgggccaaaagactaattattgggatggtgatactatccaaatttatctaaaatttcaatacaatctctactaaaatcccagctgagtttgcaaaaattgacaagctgatcctaaaattcataggaaaatccagaggatccagaatagctaaaatgaaaaataagaatgaagctagaggactaacacttcctgatttcaaaaattactgcaaagctaacataatcaagatagtatggtactgacatgaggataagcatgtagatcaatgtgatataaatatgagtccagataaaagccttcacatttatgttcaattaatttttgaaaaaggtttctaaggcaattcaattggaaagaatattcatttcaatgaatgatgctggaatatctgaatattcacatgcaaaagaatgaagtttgaccctatctcacaccaaacaaaaaaatgaactaaaagtaaatcatagatctgggggtctgagagggaatggacaataactgctaataagtatggaggttttttttagcggtgataaaattgttctcaaattgactgtggtgatggttgaaactgcaaatgtactagacatcagtgaattgtcaacttcacttacatgaacaaatacatgggaagtgaatacatctcataaaagctgttatgttttaaagcatgcatttaaaggagtgggaattatatactcaatttaataaaggaataattgcataaaatagctagattatatacaaaactaggcaatgacctgtagggcaataaaacataacttttggaatcatttttcttctgaatagaaattgcatctctacttgacacaaagctactagttaacatgtacattcataggttgaatttttaagaataaatacagaagtgagccaatggttctttctcctagaaaactaaatagtacttagttgttcccttgtatttaaagaataccttagtatgataataaaaagacacagtcatctccttgacctgactttctggttttggataattttacttaataataatgaaaatgagcaattactaactcagaattaatcagtctattcctaagcaaacatatttagttcctgctgaagcccactgatctcttcacttagtaaaagcaactgagcaggtcatcattgttagaaataatctcaaagtcactgtcagtattctttcctcctcttatatgacatcacagaaacacttgatgtgattcattaacaaatatttgactgactccatgactcaaaattcccattgtataattagaagtgtccttgtaatataaaaacagtatcatgcaaaaaaatgtgatctgcaattggtagaccacttttaaggatacttggggtaaggaagcacagaaaaaaaaaacataatccaattaaacacttaagtatctttccacaagaatattgattgtttcatgggccccaaattagcttcaagattgcacataaaatgatatcacaagaagaaaaagagacacgtttgaaaaattgcaacaaataaaatatttaaagttatacttatggctcatgatttttctatagctgtcaaactatgagtgtctgatctactactgccatgaaattgtctaataattcttaacactctcatgactctaagtaaaaccctttcactaaaataaaatttgtaggaggttaaaaattgttttaagttagtaaggatttattgaatgtcttctaaatataaagcattatgtgtatgtttatttttttgaaaaaaacaagtatatgcttcctgatatcaagatgctttagcatcagagtaagaagtcatttcaggttaaggtgtccagaaacagcattaaatgggtaacagtcaaaatgattctggctgtgacttgtctaagataagagagaatcatagccacatcattcttgattgatatgagtaaatattcaagaaagttcacaatagggtttggtgtaatgacttggcaatttggctgaggtaattcattcacttgggaaagattattagaagatatatttgaaaaatatgcatgaaccaaattatggaggattctgactggcaagctgagggattactatttaattaaagctttttaatagaagggttccagtattaagaaactaactaagaaaaatattgaatagatgatgtggaaattctcagaaaggaaggggaaaggtagggagcccaagagaggttacacaatgatgcctagaaagaggaaagcataggcatgtttcacagaataaagaagcatgattttgaaaatgggttgaaccaatattaagcaatgattcacaagtcacctttgcaatctatctattacaaataactttgaagaaatggtagataactccattgtttagggatcttagtactcagagccaaagacactcagaaacctattaggaggggaacacctcctcaattcttcccacagataatgtcaagatcagtatcaatttattctctcatagcaagtgggaagatttcttgagtcctccttctacataagaggtttgatttctgttctgtgagctcttcattctttttaaaagtaaaggctagaaaatttaaatttagaagggtactttatagacaccccagcagtctccttctagaaaatacacactacttcaactggttcatgttattcaatcagtcacaaacatttcagtgttccatcatgtgaggaaaaaatgtacagagctatgtcaggagggatacaaaatacatatctgatttttttgtgcatagagatattttatgtacaaaacattaagactttcaatccttctcctaacaaaaatctaaagacaaaaataatatttgaaatgtttgctgttttcaaatcaacacattaggcattgaatgttctttggcccactaatttacccacaatttgcaggtgttgaattttctattagtccttggggtatttaaagcatgtctataggcacgacatgtgccacttaggtgagttaattttaaaataatttaatttctatactttgctttttatttaaaattacagcatgaaactgcattagtgtcattcctccacaatttaatgatttccaaagtcattatcaagaaatggaaaactcacaagccgctaccctgtcatatggtataactaatttaacaaatagtcctatcatattcaagtcttcatatcactacaagattatcaatacagctggtggatttattttaaagtgttcttccttcttccaatgacagttttcacagatggaagcacccttccaagataaactccaatctgctgcatttaaaaaaacacttgggctaaacttcaagaagtttgcatgtgtgagaagggtgaattaacattacttttatttctggctcaagctgtaatggtgaatgtactgatgtacattaattgaatagaaaatgtctctagcaccacacacagaaagtacatgcacacagaacactctttttgtcaagctgtcaccatccctcaatgaacaacctgtgggtcctcagatatttggcaaagaagaatgtagatatattgtgaacagaacacatgaaaattcctgccctcatcgtactcatactctcagaaaaaaaaaatggagatagaagaataggtttgactagctttattctgaaaaattctcttttcatatcttagatataccacattttagatcagctttatacaatatgattcatttttagaactacacatttggttcagtgagcctcgtttaagcctatacatgtaaggaaattaataatcattcttgtagaagataacgtttttattgatcctgagatatttaactggaacaaaaacacaggcacatacaagcacgtgcacacatacacacacgtacacgagctttgaagtcatcaactgaatttgaattctgcttatactatgcacaagcaatatgactggggaaatgtcatatctctcagcctcggtttcatcacttgagacatgaagatcaaaattccttcttcgtcaggcatatttatattatgcattttttaactgtgcatggataagatgcctattccattatgtactatacaatagattcagtgaacttaggttcccactctacccctttaggctttttgtcactaaaaagattttgttaaatgttaatactgtgagtttaagattttaatatttactaaataaatattaaataaatattccatgttaggaagtagaataagaaatacagaaagaaagaagcaaaatgtatgtacagaaaatcactaatctaccaaaccataaaatatcaatgacatgggggcatatgaatggtggtaaattttttatatagaacctatataaattttaagtcacttctattactcctattttctgcatcctatcctccctgctctatttaatgaacttgagaacttacaatcttccccatgagttagtcaaaataacttagtctatgtgtgcacatgtattcaattcattattcatcaaatatgtgagagcgcttttggtaagcactagatatgaatgaagaatcaatattgttgcctctatattgttctagctaaatgaaataaaactttcatctgtatcaaaacccattcttttcaggtaacatttcttttaaagacctttatcaatacttcagcttttttccaattggaagcataatgccagaaagcactttgtacaacagccttttgatgattgtgtttgttaatatatatttgcggtagtcttatatttttatgacgtgtcttattttttcttttattaatgtcagagatcatgtctaatcaaccccttttggctgtaagcatataggcaactacatatataatactagaaactgaactactgattactacttatcgtcttctttttagacagagtctggctctgtcacccaggctggagtgcagtggcgatatcttggctcactgcaacctccacctcccaggtttaagcaattctgctgcctcagtctcacaagtagctgggactataggcatgcaccatcacgcccggctaatttttgcatttttttagtagagacaggatttttccatgttggccaggctggtcttgaactcctgactacaagtaatccagccgcctcggcctcccaaattgaggggattacacacgttagtctctgcacctggcctacttatcctttaatattgaaaatgaaaatctctataaaaggcaaaaataagaaagtgctttatagtttttgaattatcaattaaataacatgaatatatattttaaaattataaaagccccactttatccagggaaaataattataaatgcaataaattttataagaaatttagaggcttaagtttttcatttccagtaagttattaaatttgaagagagaaagaaaaagatgaaatactattttatttagtgtgtagtagagtttctacaatttgcttcaaagaggatacttttctacatcgaaacactaatacaaatacaaaaacaaagatgtcaaagctagtcatcattagagttgaaaaaaaaagcattgggtattgaaagaattctacaatttcatttatgaatattacacagcttgcaagcaaatgagaatctttaagtttgagaaattattgaaaggtgaagattattaatcaaagaatctcatattaatgtgaaatatatatatattcaaacatatataacttacatataaaatgctgaaaactttttctttaatgattatttatgccatgccaaaagacacatgattatttatgccattaaatctagactgtaatatcacaccatttgttctatacaaaaaagtcagactattttgtgcgagtttgctctttattgacgagaatatgagcaattccttaattgacagactgttgtgatgcatagtacagtgtgttattatattctacagtggaaataaaagggtttttcaaaaaagcctccattctaagtacataatttaaacccattaatagcttcaaaatataattagtatcgattctaataatttactttaaaaattttaatttttcaaagtagttttcaaaaaaactaaactcaagtttctttaacatgaagtctattacattatactttttactcaacattcaagacgttaatagcacttacaaaatttggtcatgatagcaaatgttccagccttttatattttaataatatttcataatctgcatactttgttaatatcgatagtatagtgtaatacaaaggcacactgaacaagaaatctagaaaattcaattatactatcaagcagctgtgtcattagctttgctgggtttcaaatttcttttctatacaatgagatgcctagttcaattacattttcttttggtctatattctgttacattgacttttacttattaatattaaaaaatacccaaaatagtatcctatgtgtttcttatacagatttttcttgtcttaatattgtaaaagaaaatagttgtgattccaatttaatttatatatatttagtttttatatcattagtgttttttaaaaataatttaaattttatcaaatatttacaaaagcatatgtttaaatttgtctatactatacacaaccacaaacaatatgatgttactcgtttcatataaaactggcttaagatgtataataaaaatcctttctcatttatactaacatgactcttggacttatagttgtttacattttataacttataattgactaacatttgctttgagcttacaggcttttcaaatctgaacttcctctattaaagcaaaagtgaataaaatcagtgactattacacattgtatcagctgtgattaaaagtaaaaatgagccgggagctgtaatcccagcactttgggaggccgaggcaggtggatcatgaggtcaggagatggagaccatcctagctaacacggtgaaacctcgtctttactaaaatacaaaaaattagccgggcatggtggcacacgcctgtagtctcagctactcaggaggctgaggcaggagaatggcttgaacccgggaggaggaggtttcagtgagccgagattgtgccactgcactccagtctggcaacagagcaagactccatctcaaaaaaaaaaaaaaaaaagtaaaaatgtaaccttgtgaagttatatatatatcaaaacagaagcaagatacatcttatataagcattaatgactcaatagataatgttatatccatctatccttttcacaccatacattcaattaagatgtgatattttaacaataataccccagtcctttgtctttaactctagtaaatttagtattccacaatttgccagattcaagactaggaagctatttattaaaattaaagtctggattctggaaaatttagttaatagttacattaactacagtaacattagtaataaatgaatgagtcaaggtgggcatacatttacattaataattagaaattaatattttattatagtctgaacatggtgctcaatatttattctgtagaactctttcagtttacaaagctagttttacacgcagaaaaaagctaggatactttgaaaataactgtaatgtcaaggagatgcttttagttaataacaaaatatactacacagcaaagaaattaaaacagcttggtcctgttacatatagataggtaggacaaagaagatttgaaaatagatctaaataaatatggaatcaaataggcaataaaggtggcattagtatactagagtaattattcaaaaaacatatttggaactattttagcaatctgggaggaaaatcttggtatttttctcactccttataccacaatgaaaacttagaatagggtctgtcatgtgctattgtgaaacctctcagctttactttatttaattttactactgaattttaatatattgtttttattataaaacgtatgttcattataagaagcaaagtcatttagagatttataaggaaaatgttagaaacctaacttcaccctacactaacctcaatcaaatgaagaaactaaattacatcctccccttttttgtttatatacagattaaatttttttctaaaagtagtgtcatactattcacattactatgcaatttgtcctctttcacttactacaaatatccttttagaccaataaatataaaatgcaattttaagaattgcttcttaaccttccataatataaatatagcctaatagattgagctgatactaaagtattcacccgtttttattacttcaaacaatgctataattgctttaaataatatatttgtatatgtgtccctttacattgtaattactttatttctctaggtagaacaaattaataaagcatgctggtgaaacagtacatatatttttaattctcaaatatatatccatcatatcaaagttctttccttcctgctgagtaacacaggggtttacttttcaacttcaacaatttgatgagagaaaactggtatctcattttttcatttacatcttactgactaatatgcaagcaggctaattttaatatgattaatagtcacttatatgacttctataatagtaaaatttttgcctatgcctgcactgagttatccttctcatataaattttcaggagctctttgagtaacaaagatgttaacacttggactgaaacatgcatggcaaataatttttcacttggtttcaagtgtggttagtttttattttaaaatatatttttaaaatgcaggtagtaaaatgtcctctcccatattttatagctgcttgtaattaaacttatccttaaatatgtacttttaatatctaggttagtccacctgaaaagaattctaggagataacctatgaaagattctaaaagtaaagtcaaaattattccagatctacttattgaagaagtaattaattttccactgaattgaaatgtcctccttattatatattacacactcatatttacttggttctatttatagactctcatctgtttgagaaatgtatattccagcaccaatactacattgttttgattacagtagctttgtagtatcagtatctgatataataaatcttttttgtcttcattttttaaagtttctttcttccatatatctccccaattactactcctatattttcctacaaaatctctgggttttttatcagtttagactatccactcattgttaaatatctaccgcacttttccagggcatattgaaaactaattatctgccatgactcttctaattagaaattaaaattataggaaaatagcttttaagtcatgaataggcatgtccaaggactgaaaataacaaggcagtaagtagaccagagaaatcagtgggaatcatcttaaaggcatttgccaaaccatgtaaacaaaggcttctgttttaagggtctccaagcatataggttttagaaaaaaaagctcaaggcccacctaaagtctgagtctaacataagactcaatcataaaactaggattgtgtaagtccacatcaccagaaagagaaattaaaattaaccccacctaggtcccacctggaactgcacagaaacttttcagtcttaaacttgggtacacaagaaaaagagggaaaataatgtccttagcaaattaaatttatatttgtatttttggtctgattcacacaatcttggtgactcgaaaaaaaacattaagtgaggaatttagtttaaggtggtcccagaggactggcggtaaagccactgcctgagggaagcaaatataaatcccttgtaaagaaacatgcatgcttcacagttctcagagaatttcctccaataaggcatcaacacaaatgacagagtaaaaaaataataataaaaattcaatgaacatacaagggaacacaaagcactcagtggaggcaacagatagcacagacagtatcatcagactcgcagagacttttaatagtaaaattgacagaatatgaaaacgaatattttaagttttaagaaataaaaggcggccaggtgcggtggctcacgcctgtaatcccagcactttgggaggccaaagcaggcagatcacgaggtcaggagttggaaagcatcctagctaacacagtgaaaccctgcctctaataaaaatacaaaaaaaaaaaaaaaaaattagccgggcgtggtggcgggtgcctgtagtcccaggtactctggaggctgaggcaggagaatggcgtgaacccgggaggcggagcttgcagtgcgcagagattgcgccactgcacttcagcctgggcgacagagcaagactctgtcataaataaataaataaataaataaataaataaataaataaataaaacaataaaagtcttgaaaagattaataaaaagctggcagattagaaaaaaagcacaaaaaactcttagaaatgaaagatataattgtagctcaaaactcaatggaccattttaacagcatatttgaaactggtgaagaaattattagtaaacttcaaaacagaattgaaggaaattatctataataaaacccccacactgtaaataaaaagacaaatgtatgaaacctaagagtcattgagaacaaagtaaaaagatttaacatgtatctaataagagcttcataaagaaagagagacagtgagatatttcccaacatgatgaaagaaatcaatccagtttcaataattgcaaagaaaaataagtaggacaaataaaaagaaatatggacttagataaatcatggtaaaattgtttaacatcaaaaactaaaagatctttaaaacagcaccccaaaggcatattaacctcaaatgaacaataattagacttccattcatttttcaatagtagcattgtatgataaaaggccccaaaatggtaagttctatgaagtggaaaaataataataatcattgccaaccctgaattctataattagtgaaaaaacttttcaaaagtaaaaaaaatggaaataaaaatagttcagaaacaaaaattaagatagtctggcaacaaaaaaaaaaccctttctgaataaaattttatttattccaagtagaacggcttccacatggaaattgcaacactgaaaaaattgacaaaaatatgaataaagctaatccaatattgactaaataaagcaattataatactctcatcaaattttaaaagagagaattaatatccacagaacgtcttgtaacgtggaaagaggtaattagaattaaacctcattctatgacacaaaacccactcacattgatattctaaatgacacaaaccaacccataatacataggccaaaattggcaggtcatctgtaatgaaaactggcacgagttcagaattacttatttaaatcacatggcatactcaactcagcaactctgcaggattatggcttgtgtaccctctaggaatataacagagatagaggtgggggtgtgtgtgtgtgcatttgtgtgtgtgtgtgtgtgtgtgtgtgtgtgtgtgtgtagggctttattaagatataatctacatagcatatgtacaccaattaatttagaacactgatttttgaatcactcaaaaaagatactccatcaccactagtagtcattacccacttttataaaatactcctcacctatttttgcccaactctccaaaccgagtcccaggaaatcacttatctactttccgtttctatatagttgtctattacggacattttctaaaatattcctcctaactgtaattctataactttggagacatgctggtcaaaggagatagaggttttgttttgttttgttttaaagctttgttctcttgagcactgtcttatggcagatagataagtcaatactctttaaatggatagaggggtaaatacttattatccaacaataaagatgaaggaaatgacctcctgtaccaagggaaacctgaaatcttatcactactttttgttgcatatatctaaatcttcacattttaaaaaattactgggttataaattacggactttccaacattttttcttccacttacttctttaatataatagtgggagaaaccccaatcaacttacataatagattatgtatttggacattagtttctaggcactggggagtaactacagttactgagcaaggaagtcagaatttgagcaaagctttagaaagttattctggaaatgatcaatattttgtttgataagagtataaaccattcagccattgaaactgaaaggcaaactggaaagcagaaagcaccaaatctattggttacatttctgcttttctgctttgtaacagctgtaatatgtgtgtgtgtttgtgtgtgtgtgtacaatatatgtacaatatatatccctctcaaccatatatatatacacacacacatacatgcatacacacaaacacgtatcaatgtaactttcttataaatgcaaacattattatcaataatttctgctgcttcgattttgttgtttctttaacttccagttacttttaataaggatctatcacaaagaaaaacttttcttttacatcgtgtaatttagtcagcttttctgtaacacatagtatacatttatttatctatacacaaaagccacactaatctgattacacagattttataaacacatgcaaaatcatggaaaaatcgatggcttacactttaaaagttttaaggagaatatatctctattgttttaaatacaggatcacgaaatcaaggaacactgtttaaaacagccatttatttcactatatttatagactgatctcatgcattctcatataaagtagtgttttttaaaagaaaacctatcaagaaatataacccaggattcactgtttgatgaatctgaaatgtgtacttccaattgagagatacaattgcaaacaacagcctgcacaaaccaaacagagaaaaactgactgaggggggacaatagaattgagtgtacctttcaaaactagagctgtaatccagtttgtaagaaaataaagaatggaagtattggcctaaactccactgaatcacagaagcctaacacaatacaaaacaagtgacatccttttctcaaagaggcgcaaggctcattgagtctggcgattcaattaccctctcaacctggaaagaacacccctcctgcgttgaggtccactggcaaagcaatgtgggacagcctacattgtacacagctggtaaatatctaaaaagctgcaggctttaaagaacaacagtctttgaccttttatgattgctacagtgatccttcaacaaaaaattaggagagttttttttttttttgaggtttgacaacatattatcttctcaattaatcatcttcaaatctctcatattcatataaaaatcttttaaatagatatctaagcacaacgttccattaggtaaagaatatgaacaaattaatgaaacagaaagtggatttccaaaaatagagatgactgtgatcttgcttagacattttgtaaacctaagaatcctttttgtctttttttctatacatttgtgtagaccttgaataaatgaagtgtgtactcataaaataactactgattctgaaatatctatgaaaaaattggggtagcatggatcttgtaagatagtccgtcataattctcatatttcctcatgcttgatatgaagagtgttaacttagatatatttttagcgaaaatactttagacttcaatctttggattctccttttctgatgagatctttattaaaaaatgtgattttataaatagcagtttacttcaaaaacagcaatcacttctatagtatttaccatattgaatgaatagggaaactaataattccacataaaaaattgttgagtaatcactatattagacattttcacataaaaatattattcagtttatactacaactctgtaagatagatgctacctttccttcataagtgaaagtaaggaggtaattacccccagtttcacaataagcggtttatctaaaaattcaaaccagacttcaaatcctaataaatctgacaatgcagatttaaatctgaccatgcaggaataatttttaaattctttcaagaccctaaatttatataaaagtatttatcatttttctcctaaattatctaagtacttgaaatattaagaaataaactttatacgtaaaaaggcacctggttgttgaagaacgaggagttaaggtatctttacagcattttagaaaattagtgttaaaccttgtgaaaggattctctgtatctttatgggagacattgttcagcctttgctcatccttaaaggattagacacttgggcgagctctcaatgctctcttcacaaaaacaataggtactatcaattattcaatcaatcaaccattcacttagtgaatgaaaactgggcttagacttacattgatttttaaaaaaaaataaagatcaaaattccttttgttctactcatgcccatataagccttttcttctaattttagttgtgtattttttttgctacaactctatgagtcattatgaattatttcaagtcttaaacatattaactgaattttagttaaaaaagtctattaccttgatatatctatgtgctagacttactatcaaagcacactttcatagatatttcacaaatcataaatgtgttttgatgatcaatgacagttcttgtctattagtatttagcaagcataaactaaaatcaatcttttcagtgtcttgaattttaaaaatcattcattttaacacaaactaattttcaaaacaaaaaacaatgaacctggattttcatgataaatcacaacttggaagtgcttaattaataaatgtgccacatttttaaatgcctatagaagtcatatttaatggtttaactggatttgctaagacaagctgtattctgtacccacagataatagagaacaagatcaaatactgttattttcatttgcagagttaaatctgaatttaccttgtttgcaatacttgtgatgaatgatttaatatcaagattagttggacagctcttctgacacggggcatctgcacatttcaggcatctaggaaataaaataactatgttaagaaactacaagataagtgagataatctattttctaccttatactcattcagagtccgtgtctagtaagtataaataaaatcgtatcatttttaggtacaaaacatttttaagcaataaatacaaagtttctgtgtttcatctttggcactcctcttgggatgcataaatgagaatcatgctggctagtaactgtccctcctctcagagttccttcttgattttaagagaatcatacttatttaggacataccattccctcactctatcagttttgtttcatccttcactatgctgacaatacttgcatgcagttttttatgataaggtttgtaattcttttagaccaaaattattaaacaaatgcaaagattaaaggtaaagtcttattttaccacttgaaatatcctttcttccactcttccttcctcccagcttccctctctacctctctctctctttccaattgtctgaagtctttcagcctccatcccattcacaggacaattgagttctgtaacagatgcctcaaagcatagcccagatccatacccttcaggaccaaagctttattcccacagctgccttccctctgctgctgaagagaatgggctccaacaaggtcagcctcctttccagtagcagcacacatacaattcaaggtcagtgagcggggttggaggctctctgcccattcccatatttggggaactagtctgcaaggagccattgaagcatttattgtgactatttgctcagtcccacttccttcactcttctacagatgttaacctgcatataaacttcctgcatattaatctcatctgactctcctctccgggggactggccagagatgtattcaaactttgttgcacctaagaaccacctgggaagcttgataaatggcacagacttcacagaggagcccctactgagtccaagttactgacctgggaatccgcattttgaaaagggcctctgaagtgattctagtgttcatagttggaagcacattgttagaacaacattctataattattcattcaggacaactaaaaccaatggccagactcatcctttatttgcacattaacttatgtgtgtttttcttcatttattcatttatttaatacatatttaataatcctccattacatagcagaccctgggatatgagaatataaaagtgttggaaaaagatcaccatggtcctgccatcatagaacatgcagtttgaatgaagtacagacacagaaaaagccacacactggtcaatgtggtcaatgagaatctgggtgaaatatagcatgctaagggagcacagatgaaagacagtagtcctggagggaggttgtcaggacaggcttcttgggaggaataatattgaaatagaagcttgaagaacgagtggacattaggaaagcaaatgacagtgggattctgagtgcagggtcactcaggataattacccaagaatagaaagagtatgcaccagtgcctggaaagaaaagaacgtgacaaggtaggtgaactaatgaatttggtctagcataaagtgagagtgggagtagaaagaaatgaatgtggagacagacaactaaagaaaatatactactgccacatgtgtcagaaaaacagcattctccaagaatttcactgagcatgaatcctacattgctcagtgacaaaggtgactagctagttcattttctatacacttccatgtgtaaagaccttggttcatttccttcatgaaaacaataccagtctccttgtcattcttttgtgagtaagagagccctcttcattgtctgaaccaatttctcagtgcctaattaatatcttgtttttaaatctgatctcttttctctggtttgtgcccttagccttctctctaaattaaattttacacaatgagtaccaaaggcttttcataatcaattgtcctctctgaaatgtagtcattaaacctcttccctatcatttctctaaatgccattgttagattcacatctatcatttagttgaattcctgtctgctcatacttaacgttttttccccgaaacactattgttgagttcaaaaataatttcttcgaagtataatctgcagcatacattgcaaacaatacaaaaagctccataatgtatggcctatttggtccttgatgttaaaatgaggtgatatttatatgtgtaactgtcatgtggataaatatactgagcattaatagtggtttgaaaggattttcttttatgtcgcaatacaaaatagctaaaaagtaaataatatgccaacttaaatgtcaccttattgttgaaaaaaagtcttttaaacagttgtaaaaatatctgccatcacacaaaagtaagcgcacacacacacatatatggcacatcatatggattctggttatctctatgaagtcacaagttttctgcttttcttttttctaacacccaacttgaataataacacaattaaaaaataaagttataatgtcagcagatataagggaaccaaattaatgtgcagtgtatttttctgttcttccagagaaatcttatattcaacataaacagattcacttaacagtattgacaatgtaaggatttttagttgtggttattaagcctctttaccaaataattctccttttattattgagctagttcacaaataacagctgttgaaaatgtcagatgttaatgaggcagggccacgcaaacctgaattgtagcattcctttttcctttggtgtcatgaatatgccagaatgggcagactctgataataataccatcttgcaattctctaagcgctctgcagactaaagtgcatcaggctgccattaatcccacttatcactctgacagctcagtaattacactactgctatagccaggtagtcctaataaaatatcaaccactgcactggaatgcatactggtgagatgttttattaaactttgagcggtgggggttgatcatcaagtgacattagtgttgacctatttttctatttgacaataaattatcctttgaccatgccataatagatattacagagtgcatttactgcaccaaatcagaaaggtactgcattacaatgatataggcaaatggtgtaaataaaatagcagaaatgcatgtcagaatgttattacctaaattgctttaaatgattgataccatgaaaaatcacagacacagtacttaggggaatatgtcaacaattatcgtaaaccacagttccacataaatttctccttaaaagtaacatttaaattacacttgttttcatctttagtcatttaattccccttttacctttcaaagttactctgttatagtgcagtttatttttaaatgcataagcagcaaaaattaattcagagaaacaattatgtcatacattttcccccaaatagttgttatacataaagaagtatatttgatttttttaaactacaagaaaacaacttagagttttcactaggcatacactttttaaattttcatatttaatacaaagcataacaatgaatttgtcgaagagcaaaatatagaatacttaatcaatgttaattttttataatttgacatgaacataaaaatgtatgaaaacttaagtactgttacttaaaggccaaaaactattaaagatatatttatccatgatatttctctagagaaagagaaacatgattcctcttcccaaatatccgtgaggctagacagtttgactccatagtatgacaccaaaaatattatagtgagtaatgaaacaagcggcatttcattcttcacacatctgagaacagatgcctgcttcttttattggtaaccatccacagcatttggaattgtaacctatgcttgttaaagaattttctagtcaatgagtttaaatggctgaattaatttctttctcagataaaaaataataataaaaaaacacatacacacaaagctatctgaaacccttaaaactcacattgcattgtcttagctttgctagagtttggtttaattgagtcagcatggtttcatcaggctatgtaaatatacgttaatctatatataatggcattaagcaagaaagtattcacattaaaaattaaaatattttcctaatattaacattgcatttccttagatatttaatgttctacatcatcatttggaaagtctacctaatttacatgtatcagatggattcaaaaccttgtttccctaccctataagcaccagtgtaggaaaatacataatttaatatcttcctcagtggtgcaacatgtctactgaaaactgagcagaatcaactatcaggttgaaaagaaatgtgaataaagaaatcaaagttggaagtgtcatacatgtatgagttccacaacttttatcctttgcttccagaccctatcataataaaggagacaagaaagatggctggtatctttaaaacatgataggactaactccatgttctgatccattaagcagtcaaaacagtcaaaagccatcctcagcttccaataattatctgcctatttatacctctgtgcttctcttaataatccattaacagcccttcctatgtacttctgactctgcttttctgattacaccacaggttcttaatagcttagggctatctggaactaactttgaatattcttaaatatgcatcttggctcagcctctattatactgagctggcagctatgataacatcaatgaaaataactgaatttttaatgctgtgcaccatttgccttttaaccacacctgtgatgttcatgttttgaggcttttgatatttatttgtatttacaagttaatgccaaacataattttaaatagctatttatctactagaaatttccttttgcacatgggtgcttcaaaacaattcaagagaagcaaatttagaacagaacacaattcacacaactgatgctcaaaattatttgttggatgataataaccaggaagctgggaataaaacacagttgagaactttcctgtaagtattttctgacgtctatgtcaggggattattggttttaccatataatagctttaaaatgtatagtttatactttttgcatattttgaattaaatgaagggacttacattaaattccatacacattatttatcttcatccataacagattcctaaaaatttataagactacctctatctccacctcatagatgaggctccagtcatctcccgtaagcataaaagaccagtggccaaggcagtggaggaaataactaaaacacatttagtatcttacacccaggactatcccatctacgtacaaaaacaggttagaattttaaaaggtggtgttctagtgaccccatctcttgatgacatcagtgcctccttgccagagtaatttgaagactgagaaaaaagcagttaagaagtcacagctagaaaaagactacagtattatctctcctggagtccaattttagtttaggaaaaaaaaagtgaaaggtagtcttgactgtctcctcaagaggcttctcaagtccagatgaaaaggttggagttttacagtatcacatagttttgaaggcttacccaaccttagtagtcattgaggcactatgactcagagaaggaaagtgacttgtcctaaatcttcctcagagtttatggcaagcttttctaactcaatccattgcctattctagtctgtaacatttattttcttctaattcatatgctattattaggaagctagttttattacaattttaagcaactgtgatttagctgtttgtgctggaaacatacttttattagcatattcttattaaaaattaaatatgctacaaaatcctcaatagcataagaaaccacaaccccaatcaagtactttgtgctgtctcacaagcaaataaaatatcttcataaaaacttagtacatatcaccttttataaaattttaaacaaagcttgtcctattttactatacacgaaaaatatacttatgactattaaagactgttgctcttaaacgtatttgtttcgctttcttaccctggaagatatctggataaagaagaaaaagattaaaaaataggcttttggtatacagtggtggaatacgaaagacgtgatggaaattgtatacattaataactgcaaaggagtcattggaagaaaatacacacatcatgaatacaggtacagacagttataaccaggaatgaaaagagaacagagcccatatgaagaaagtagcgtcagtacttaataatttctgaatctactggggctctcacttattggaaatataaacgatataaaaatgaaaagatttaaatagtaacactaaacaacaatgaccaaaaggccaaaagaaaatgttttttgttttttggattttttttgttgttgttagtggtgtgtgttttttttttgttgctaaacgaatgtactgataattatgctgaaaattatgggattgaatgaaattactgtaggttgcagcatgaaggaaaagtgtcccaattctgactactctctgttagaaatttatttatggagcataagatcatggtttataaactgaattcttaaaactgaacaaaaaataagttattaattacaactattagaagtaattaaatattagctattcaccagtttttatatatcaataatacagaaacagtaacagtaaagacaatgaataccagaaaaaaatacgtaaaagcattcattaaatgttttcctgcccagtagatatgttggcactaaaatagctgatataatttgatccctgtcacctgcagctacaagtgaggtacactttaatcaagaaaaccagagaataccatagataaaagctctgctttatgtcctggagggacgggcttgttggcgacactctcctaggaagccattctttattcaccttaaagatggtggggattgagagtatgtacttaaagggattgaggaagatggcaagattcaagaagatcagagtttcctctgtcttgtagtaatgaggaaaatagtgataagccatgtacctaggacaggatgctttatagaatgtctatatttagcataagtcagtcagataatacatagcatatatgtatgtagctatgtatgtacatagcatatatgcatggacccagactttcgtgtatactaatattaagtgctcaaatgtgcttgctcatccaaggcctttaagtgtattaactcagaaagcgtagcattgaggttaagagtacaagtgctggtgcttgattgcccatatttaatttttgacttcactttactggttttaacacattaggcaaaggacttaaactctctgacatgacttttctcatttgcaaatggggataacttgtacatcaaattgttgcgataatttttaaagattatacccttatatgcatttctttagtaacttaacaggtattctctacaatcttcaatatattctgaaacttatatattgctttctcttctttaatgtggaaggaattagtgaagagtcaatgtataatgttttataattatttatgtacattaaacatagtagacatctgacaaacatatacatatgctttaagggttcattttctccatacgggatttcagaagaaggaaaagttattttcctctcaggagaaccagagacgccttcttagatagagaaacttatgctgaaagttgaggaacaggtaggttttgaccatgtagagattagtataatagatagatagaatgaagatagattatgggttcatccaggacaaagagtataatttggccaggcacggtgactcacacctgtaatcctagcactgtgggaggccacggcgggcggatcacgtggtcaggagatagagaccaccctggctaacacggtgaaaccccatctctactaaaaattcaaaaaaattagccaggcgtggtggcacgcacctgtaatcccagctactcgggaggctgaggcaggagaatcacttgaacctgggaggcggaggttgcaatgagctgagattatgccactgcactccagcctgggcgacagagcaatactccatctcaaattaataaataaaacaaaagactataattcatctttggttctcagtgcgtatcctattagcgggcacatatataagtgctcatacgcgtttaagaaacatttctcagtcactgtacttcaggaaatcaaacaacaaaaatacatgtcaatctcatcagtggtccaatattatttacagtgtactgtatatggaatcctttcttcttgaggcttttggttgtttccccatggtaatggtatgatgtaaaaaatattcttctaaaataattaaattaaaaatgacaggttggacaacacaatgtactgtgaagcttctacttttgaaaatggctacattctagctaaaaatgtaattgatccttattatggttgcatatgtttgaaaagtatctgaaggatgcaactggtaagtatgagaatatatgtgacaaaagacgctttcctttattcctgctccacacattatctctagctattctgtacagcctatctcccttccctttctcaattgttatctaatgagatggcaacaaaatatttctcatgttccagggtaaggcagcaaatttccgtgacaaaataggctatccatgtacaaatatggtctatctttctgtaagttctgaaagttatacattgctttctcttctttaatgtggaaggaattagtgaagagtcaaagagtaatgttttacaattatttatgcacaataaggatagtagatatctgacaaacatatacatatgctttaagtgttcagtccaaccatttttacattttgcactggtcatatgaattgactaggcaaaagcaaaccaacgatactcccatatatgaatttcctttctcaaaatccttccaaagctttacaaagaattcagttaagagttttaatagagaattttaaagagttcagttaacagctttaacagagaaatacctatatcttatataccacattaatttaaataagtttacataaatgcaaccacatatatccataatagagaatagttatgcatttagttaacacgtagccatattctgaagcccaaggttcagagtattttttacagtccaatcattttatagttaccatttttaatttaacaataacaagccatatgtaatttttttttgcaaaccaagatattgttccctgctcaccacaactatggtttccttcatattctagacagctgttacatgatgctcaatacacttttgatccttcacagaccttgatgacagtactaacagtttttattatagcttttctattgcactgtaatcttatttcacctggaccatttccccactagcatcataaactctttgatttatatcaaataattattccaggcttcatagaaaaaaaaaggaattattttgtgttgcatattcacatgctatgcaaattatcttcttaatttttgaaacacctgttgtatgtttatcttaatttcaatgaagctcctttagaaaactttaaaaaactaatatatatttttcatagatgccctagaagtaaacctctcagcaaacttcaaaacagagaaagctctatattttatgacatatttgtgggcaatttcagaaataatatattagtaatagtaatctgacatatagatttagagtgcatgtaccctagaacttaagataaaaataaaaatttttaaaaaagaggtgaaaaaggaactcaaattgttaaatccataaataaaataggttatttgttcctatacaattcctagatgtacggaatatgtttgttatgaaaaaaacagtatgtagacaaatatgtaaacccatcttagggcatgtggactaagatttgggatagattttacttttcacaatgctatattgtttgcgttttttgcaataagtaagtataacttacgttattaaaaacaagacatagatgttgactaaaatcacattatcctaagtaatttttactttttgcactggtcatatgaattgaccaggcaaaagcaaaccaatgatactcccatatatgaaattcctttctcaaaatccctccaaagccttacaaagaattcacttaagagttttcatagagtgaccataatggatattcaatttacacaggtttgaactgctgggctcaagtatacatgggcttttgttttcaaccaaacaaggattgaaagtgtagtatttgtaggatacaaaatttgtctatatggagggccaactgagggacttgagtatgtgcaaattttggtatatgcaagggtcctggcaactctctagcatataccaaaggatgaccatatttctgagtatttggtggctcataaagctaccataaaaaagggctgaggtggatgaaaagaatactgagtgacaatgcaagtgctggaggcactcattcattaagctgaaacaatagtgaaaaaaagtttggccttaaaattaaaagacagtattcatcaataatagaatcttgaagtaaataaatgtctccacatattagctgtgtaggtataattgaacaacagaaataattcaactcaaaattattaaaaggttctgtgttctaagttctgtgctggcaaaagggaggagttactggaacctacttagaagaggatgacttaatatactggacacatacttcatggagagggctttcaaaatatatatatatacacacacatatatatacacatatatacatatatacacacacatatatctatacatatatacatatatataaacacacacatatatatacatatatgtgtgtatatatacatatatacgtgtatatatatatgtatacgtgtgtgtgtgtgtgtgtgtgtgtgtgtgtgtatatatatatatatatatatatatatatatatatggcaggggacagtggctcacgcctgtaacctcaatgctttgggagaattacttcaggcctgggttccatatcagcctgggcaacatagaaagaccttgtctctaccaaaaaacaacaaaaatgaaagaaattagccatgtatgatggtctctactttagtcacagctgtaggctgaggtaggaagattgcttgagcccagaaggtcaaggctgcagtgagctatgatcataccactgcattccagcctcagtgacagaacgctgtctctaaaaacgattttttttttttgagatggagtttctgtcgccctgactggagtgcagtggtgccatctcagctcactgtgacctctgcctcctggattcaagcgattctcatgcctcagcctcccgagtagctgagatcacaggcctgtgccaccacatccagctaatttttgtatttttattagagactttcaccacgttggccgggctggtgtcgaactcctcacctcaggcagtccgcccacctcagcctcccaaagtgctgggattacagctgtgagccactgtgcctggcctaaaaaaagatttttttgtgtgtgtagtttttttctttaaaagtgcaacagtgattgccattattatagaggatgaaatagcacatttggaaagcaatgtccatatatgaattgtcttcctcttagaactgttgagtttcatgtgtgacatccatacaagtttatttggtagttttattccataaaaatggtgtcattctcccttttacaaaaataaaaagtaaacctacttcacacacacacacacacacacacacacacacacatacacacatacattaaatttaaattcaatttaaatttaaatattcattcattttacttagctaaatctatgttgattacgccaagtgaaaggataatttattcagcacgaatttttttctaaagttttaatgcaatcctggtgatctttttaaaatccctgtctgatcacgacattctccttaaggggagaatcttggtacaatattatctctgagcctcggcttctattgcatttccacagctacagctgcaacacctgcctgatgctagaactctgctcatagttccatgtgtaggtcattttcaaactgtgcattccacatgctcttccctttcctgaagagccacacttcaagtcttcatccgaactcagctcagatgtctcctgtgaaaccccctggctatcatgcttggagccattctgatctctctaatagcaccccgtgggttcccttatcaaagcaattatcacattggacagtaacagctgattcacttttctagtctatcttctatttcctcctccagtgagaaaatggttgggttcctctgtctttgaggttagtctacttggaaatagattaatttgaattcagatgaaaaagccagaattttggcaataatccagtttttgtacagttaatgtttggtaaaaattattttttaataaatgttcttcaaatttatgtaaataacaaatctttataatttaaacattatatttaatttatttagtaggtatttatgcaaggggttactatatgctagcactgttctgtgtgttttataaatgttaactcatttaattttcataatcactcaatgaggtagatataaatattaactcctatgtttataaaaacccaatgagatagatactgttgttattctcattctaaagaaaaagatattaaggcacaaaatttgctcctctgatttaggtttgaaatatgttactgcctatttgtatgatcctgataatcatcaagaagttaataaagatctcctaaaaatctataattctggttatctctgccatttcctcagaacagagtatggtgacatcaaggcttgtctcacagtttgtgaaaggcagattcaggactcttatccaggtttgacttgctctacagaccagcctgtggggatcatcatttcatttctgcaatagttctcataatgatagccagtaatcccagagaacttgagaaagtttcctgaaataacacattaaaaccaagcataacatagtcattactatatattttatatatgactgaatttagaaacaagcaaacaaaaattcctcatttatttactaggaactcagcaataatacttgcagatcatgtaattatttacaaagcattttctcgtatgtaaattacctatagaaatcagtaagaccaatctttccagtagaaatactagacaaaataaaagcaattagaaacaacatttataactatcagaaatatgaggcataatagatacaataaaaatatataatggataaaataaaaatacatatctaacttatataactttgactctaaactaattatgtccctatccagtatctggaatattatataaaatgacataaaagtagctcagaacaaaattgtccccattaaaactattgtgtgggaccactataacctcatgcaagcttttgtatgaaatggcttaagacatgacttttgttcttaggcatttaatgcctaagaatcaatgctgatgttgcacataaagaatatgtggaaatttcaggaaattaatgaatatgggtgaaaaacagataagaatataaatgtttaatcttctcagtttaattcatatcataaggtagaccacgttttcgggcaatggcactgcttagaaagtgaactaatatgaagatgacctattcattaagagaagattttttgagaaaattagcctagaagctaaaggacacaatattcagaaataatatcttaaataacatcaataaaattagctgtctacagcttaatatgatttaaactagaaaaacaggaaaataaaaaagctaagggcaaataatatatagttttgtaaaaatggaaaattccctccactatgctcctaatgaaatgcataagagcactgacaatgctgtcacagtacgtggcatgctccattaatttaagaaagctgaatgaaaaatttgagtcaaggtaatagtacttaaatgtgtttgtgttctgcggaatcttaacatgttatttgcgttgttccttcattctttgttttcttctttccttcaatcaacaaatgtctatagagcacttaactattttctgagattttgctaagtgctggagatagcaggatgaataagttataggttcagccctcaagaatcttcacagtggtggagtcagataaataaatgcccatcctcagattatgtacaggtggggtaatagaaagataagagatacagggtgtttatctttttcttcaattaaaaccctagttcagaggtacattcatttgttcattcctctatcttcaaagcctagcatcatgctaaggacacaatgacggttcaatgttcatttgttgattaaatgaatgaggtatttatttgtttcttcgggacgaataagagggagagagagtcttgtggacaggccaagtaacacatggctttaagaagacacagaatgtgaggaattgaaagcacttgttactatcctactgaaagtagcatagaggttgcaggacaattctatggatggccttgcaccaacccggttctcccctctttcctgcttgtaggtctcaagaacaactatagcatgtgctgtaaatgcagcatcttgagctaagaagggacaaggtagaacagatcaagctctgctctagtctcccctagaaacagagattccttcaacactttagcccaatatgtcctatgaccctggggtataaaatccagggcaggctgcttccctgaatcccccagctgtgatgccagtgggatgcccccattagtgataccatccatgcctgggcaactctcctaaaccttggaagactggcccacaatgggtcttaggctcctgttttccctactatctatctgtaagtaataaacctgcttcatgcaacttgttgcatgtaagcatgttttgtctcaccagacccagacaagctggtaactgtgcacaatgagtctgcttcacagagctctctgcccaaccacatttaattcacccccactgtaaacaaatcatcccttctttcaactgatctctcttcttttatccacactccatacatttgatacccaccacaacacaatatcataaaaggcagtatggtttaatggattctggatttaaatccagctctattattagctttgtgatcttgagaaagttatttaaatcctttgtgtcccagtttcctcatctaaattgctaattatagtctagacatcataccattatagggaggattaaataaataatatatgtggaacatttggaacagttcctgccattaatgagtgctcaataatgtaaatcatttgtattataatctaggaacaatgcagaatacaatgtgggaaatgagcactgttttttaatagccacttggaagtatagagctatggtgaaaactgtaaaacagggactaccacatcagttactgtgaaaataaatgaggtaattatgacaagcaccaacatcatatttatagtagctgctcaataaatgttaactagaaaacatgatgaaaaatgtctcaatctcccaagccaaccaagggggaacacagaagggaagtagtatgttgaataaaaataaactgtgtaaccaaagagatcataataaaattgtaaatattacgtgcatctattaggattataatgaaagcagcagccataccacaaagccaaacataaactgatctccatagataccccatttgcacgatgagttacattacacaatgacttggcaatcattatcttatagcgcagggtggtgggagcaggcagggaggccaatgagtctccctttgtcaagggaagatctctgatggaagtttgatttttgcctcgtttattcctcacatctaaaatggatatttttccaaaacatgaatgccttccatatgatgagacaacactaaaatttctgctttaattaaacagaaagaagaagagaaacttattttaaaataatattacagaaatttttcttatgtgccaccttttcattaagctgtgaaatttctcacctgctccctacttggtatttttttaaggtgaacttttcagaacaaccccacagagaggaaattgctttgcaagctaggaagatattaatctgttctcccagcatcatgggtgcataaatcctttcatattgaagaggtgttgttaaagttctatatataagatgacagtacagtattgactttagtaatgctaatacaaaagcagtattttcagttaaatatgctatattctttcaattttcctgcctttacttttgcttttccctcaatagaaatgcgtgctgctcattcccactccctatctggcaggttcctgggcatccttcaagacacagcattaggtgtcatctccgttgagaagctttcctcaactaccccccactcctcctaaatgttatttttttcttattcatatccccatatttttcaaactataatataattaatttgtaagctaactgtatccccaaatatcctgataggtctcaagaggacattcattcattcaacgaatattgtttgagtacctgttaggtccagggtcaagggaaaatgatggcaagtaatacagagacagattctttctgtaactcagaattaaacaagtgaacaaacaaacattgcattgtagactaagcttaaatcatgatagcacagcacagtgagatcaggggatcaggaacgtcttcctgctaagtcaaaaagaagcaggagttagccagggtgaggagacagtggaagaggcagaagagatgtgcaaataccatcagatgcaggaggcccagcatttggaggctctgaaagaaggccctggtgactgaagcaggaggtgagtccagggaggctgatgagggcaaggaaaatgccaggttagtcttgcattttcagcagcagccacaccaggtgttcaacaaatgctttttgaataaataaataataatactaacaaagataacgatgccattgtttggcttttgaggatatgcgttcctatcttgaaaaaactgaaattgttagaaggtaatttacctcccattactataaataggaatatttttgccttgttaagactttccccttttcatatacttaaaaataatgtagacagctataattcagtattaaatacagaatataaagtatttatgatgcaagtaactagaaaaacacacatcttacatacatcagcttccaagacaagtattcacaatatgtaggaagttccactgtggatccaaggggatgtagatggtacaatctctttaggaaaaaaatgatcattattttctacatagtgttaccaaatgaatacccaataaggcagcttggcgctaaccatttcttttgtctgcactactgaattctcataatacgcactgcctgagaaatggagcgcctgcccctttttgattatctcattcatagacatctcccatcacaaaatacttcagtcatagggcaatcaaagatacctataaataaactcttgagggaagacaaataagaaaatctaacccataattgtccctctgcattgaaaaaacactggacaaataatgcaatctggctgccattctgttatcaacaaattatataacctttaacaaactacttaacctctgctaagtgaaacctcatttttagctatgagcaatgggtgtatgattaggtggtctttaaagtgccttccaacacacaagggccattaccccatatcctcttcacatatgtcaaaagtgttatcagattatgagagcaaaaaaaaaaaaaacagtttcattttaggggaaattgataatcaccaaaattttaaactctgaatgtttctttacatgagagacattaatctttcaataagaacatagttgaggcctctcctaaaatttcattagcagtgaaacccttattttaaaaagaatgtgaataacttgaatgaaatccaatccacagcagtaaaaatgataaaatatttgacaactctaatctggtccaaaatatttggctacattaagtgattaggatatagaatgtttccagcttctccaccctgtagttcttggcagtccgactagtaaaattttggaataagtccttaagagagttatttaagttcaattttgagaatcaggcactgaccttcactacagtcagcaatttcccatttatttctatccctatcatgtcattttagcctcctgcacaggaaacatcaagcttctttctagaaagtataagacagaataaccaaaagatctggtctggagccagaaaataagagtttatatcctgtccctgctacttggaggctgcagggcttggctaagccacttaatctttctaacattctccatttgggaaatgagacaatatttaccttagaatcatgagaatccaataaagtacacaaagtgttggggcaagcagctattcaagacacagttatttattcacttatacatggtttgctggtgttcatgcccattccaccaacaacttacctgcagtgtacttctgtgggactaaattttttggcttgtgttttgcttacttgctgcccagtctgtataccagcgttactgcatcctaccaaaacaaagctttgctgcattggtgttcagaaatatttcactaaatatcttaaagttctaagagcccaaggcatttgttgactaatcattaggtcagatttcttattcctcttgtcctacttcccttcatgtttctggttaatgcttcttaaaattgctaaaaccttggcttttgagtctttactgcccatttagcttttaatattatgctcaccgactcttaggcaatccaacaaatttatccatatggctgcttctgacctcacaaccatctttgatatttctttttcctgctagccatcaagttacacataacagtggaaaacagcacttatccaaagtaacattgaaatatttctcttagaagacaagcaaatttttgtttattattgtgtagaaaccattcagtactggtattttttcagctgtgctttgttttagatgaatatttgtaaaacaaataaatattacattgtattgccaccttctacaatcttttatgtattttttgttgtcctaaattgatatactgttactaaaggcatgattctgatttaattcacttaataattacatatttatttattgaacatttcctagatacttacaatgggacaaacactatactatgcaccagagtttcaaagatgatcagaatgtgatccataacttacacaataaccatattattggacagcaaatacttaaatatccatttatggatatatgggacgtgataaactaaaagcatgcgcaaaagactctaaaaacacgcagaaaggaatgggaagaaacaagataaatgtcccatagaaagtggcttttgggatgaatcttaaagaacgatgtcttcaacagagaacggaaggaggtgttttggtggaagaagcagaatgggcagaggcatagaatatagaagtacgtaaagcactcagggaaaatctctgttcctcggaagagttaggataacagatacctgagagagggtagctggaatgaaattctagtctgtattggaactcagttttactagtcctctaagaattttgttgtaaaacttttattggaagcccatcttcattccaaatatacagccatatttgaatctctctctcacacatacacaaacacaccccacatatatacagttgatcctcccgtatcagtgggtttcacatctgcagatccaacaaactgtaaagcaaaatattcaaaaataaatttcaaaaaataaaaaatagcaatacaacaataaaaataacatgaattttaagatacagtatagctatttatatttgtatttacattttttaggtatatgagtaatctagagatgatttaaagtatacaggaggatgtggaaggatgtgtgtaagttacacccaactattaaaccattttatatcagggacttgaacatcagctgatttcagtatcactggggatcatagaaccttggtggacgactataatgtcaaagtacagagggcacctaaagaacaactgagatacttcagggatcagagaagaaacaaagacacagggtagcaagcataactgaaactacaggtctgaagtgctccaggttctgaagcaagcagagatagcctagaatcaactctgctagtgtaattgagaccaaacgtcccctgcctcaggtgggggactgtagttaagctccttgcttcaaatcgtgggccaggtggataggactgatcttcccatgcaaggggttagaacaacactgaaagtcgtgctaattaggataatataaaaccgtatgccaaagagaaaggaggaatccaacacagatgtagcttgaatctaaggtgtaggtccagccacccctcgtgtggtttccatagataaaacatcaacacaattatcaatgggactactcccagagccaccagtttaagacatggttctacatcaggtggcttaaagtccatgttgaggcaatcacagagttgttagttcatcaagataaaaacaaataaacacaacaatcaccgtagatgcacaaattcacaaaatttctaaaatgatacaaggaaaaactaataccaaagaagactgccaattacaagaaacaaatttattacaaagtgaaaaaggagcaatctgaaaacgtctttaaaattactgtttaaaattctcataagaaaagaaaagaaaggaggtactactatcccttaatgacaaaacgagaatatatgaaacaaaatgagcagaaattaaagagaaatggagggtactaaaataagccaagcagaaattctaaagatagaaaatcctgacattacagctattactaaaaagccaaaaagtaacagatgctggcaaggttgctgagaaaagggaattcttacacactgttgctgggagtgtaaattgttccaatcattgtggaaagcagtgtggcaattccgtaactgaaaaccaaactactgttcaatcaagcaatcttattactaggtacataaatcattctaccataaagacacaactatgcatatgttcactgcagcactattcacaatagcagagacgtttaatcagcctaaccaccaacactacactggattttttaaacagtgttatatatacacaccatggaatactatgcagccatgaaaaagaatgaaagcatgtcttttgcagaaatatggatggagctgaaggccattatcctaggcaaacacacacaggaaaagaaaatcaaatactacatgctatcacttataagtgtgagttcaacactgagtatatatgagcacaaggaaggaacacaaggacactagggcccacttgagggtggacagtgggaggagggtgaggatcaaaaaactacctatcatgtactatccttactacttgggtgacaaaataatctgtacaccaaaccccagtttcacacaatttacctaaacaacaaacctgcacatggactcttgaatctaaaataaaagttaaaaaaagaaaaatctgtgattgaaatgaaaaagtaaaagatgaggtacattccagagaggacatagtcagagaaaaatttagtgaattggaatatgttactggagaactcatataaaatgtaccacagagtgacaagattaacacctttatatccgaggataagaattttagatattattgtacagataaaggagagccattaaggttattattcagaggatgctgtagaaactcaattctggtgtcagtataaggaatgagtagcaggttattgtcatagtcctgccaaggaatgataaagtcatgaacaaatagctgatagaaggaatggaaagagaccaattatttccccctgcttttctctgtaactccattaagtcaacctttatattttaaaactgcttagattttgttaaaacttgattagtcattctctaaatcctctccttcttaaccttagattctctctccacatttattcctgtcttcatcctttctttccaatctacttagcagagaacttcagtatttcttgactagaatataattgtctttttttcccaaaaagatgtacacctccaatttgttttaagcatagcagccataacattttcaaagaactgtcaaatcaagctcacactcccgaaatagggtagtagaaatagcagtctcttaaaagtaaaatggacttagattcaaatcctgattattctacatattaaatatgcgtcgtcacaactgctgtgagcctcactttcttaatctgtattaagtggcataaaaagctccttcttcctagagttattatgaggaacaaaggagattaagtctctacagagtctagcaaagtgtttgtaaagtagtaaatgtccaataaatattttgctatcctcattaacacccagcatgaaaggtatttcctaatattcttgactgagaaagaaaagaccaacacctccattgtgccttacttttctgtttatatatttgattaaactaatttatggacacatctatctccccctactaaattgtaaaatcatttcagagcagggcccatattgtattcctttctgtatcattatatttctagcacagtgcccagttaataggaggggattaataaatgttagattaacaaattattgtagataaagtctaatttatcttccactcagtgcctatacatgcaaccaatgtttttttttaattgcacaatacaaacttcttaaattattgttaccttctcttcctcttttttctgtttctctcattccctttagttttcttcttctggcaaaagcacacccaatctaccttcattgtgtccatcaaggctgacctatcccttctctgaactcctccatcaagaaaggaaaatgaaaggattttaactattatatccaacaacatactcttgtttcctagtctagtttgtcatacacagtaggaattcaaatttgttgaactcacctgaataatcttgcctattgattaaaatagttcttgcataggggtaaaatgcaccatataaaaaggtaatgcatcttttaaattattgtgatttattaatttgattatttttgatttatgttagggtatttgaaaagaatattttaaaataaaaaaggcatcaaaattctcaatattcatccaaacatttattatgaatcttatttttctctgaatgtaaagcttcatactagcttaattagtatgcatttattgtgtgtgaaaacatcctcaaggattttcgttttcttccagtcaggtcacaattgtttgcactaacagttactacatattttattaattcagaatgaacataaaagtaggatgtcatcactgtattcaaaaaataataacactgctgacagaaccttttgtggtgagaaggatggcatgagacgggaggaaagacaaagttgataaagaggaaacaagggtcaaagcaaactgaataggaaataaaaccgatgaaggggtaaatataaaacaaaaagtgaaaaaaggagggaagattacataaagtaaagagagaaaaacaagaaaagagaaaattggagaataaagaaggaaacaaattataaatgcatagttagatccataaaattctagcactaggaaattaaaatatagtataaggtaaaatgactgtcttcccaacacagagatttttaatattttcccattccctactcagaaattcttgtataattccaaaacacttaaaaggagatctgtatttagattttaactatctattctggtttagtacaaaggtgacattacatctgcactacatgttcaagttaataataatgaatactttttagcatttgtctttcagttctaagcaaaaaaataaacttttaactttatcactttacacaaagttaattgtccaattttcagttcccatattttatgtgaaaagaagtaaactagttctatttataattaacttacactttaaagaatttttaaactctagggaaaatatctttttcctaagaataaactttaacaatactttattatgatctgaaatgctgatttataaatagcttcaccatattttacgtaccatatttgttttagagatttattacgtacttctccctgtagactgaaaattatttgaaagcgatgttaattttaatttatattatatctctcatcctgtgaacagtgcccaacaatttatacattcaatgaatatttgttgaatgaattaaggaataaatcaatgagatgttatagtttaagtatactttgattaagttctacgtgaactaatattctcatatgtttgacatatttgtatgtatttcttccatttgaatctacctattactaccaggccaatcttctttaaatatttatttcataatggtattgcccatttcctaaacattaagaggaccaactctttctaaagcttaaaaatataaatgccttgacctttttcagtcacagattttaattctatacaacgccttcactcttgagttttacttttagtttcaagcattgtcataaactcattgtgggagttgtttatagagttttggggaaggaaatgcttttctattttatgtttcattgcttggatatctaatccatttatcaacaaagtattttcagaaatttgtgtttaatatatttctttggtctaaggctatatagagaggctactagagcactgtgcccatcagccattactctgaggcagatcactggagctattcaggtataagctcacaggacacagaaccagctatgtaagacagcagctaggacagtcaacacagagaatctaccccaggaattccatattccatttttacttaacagctcacacctcccaggtgggtttaggaaatgaacagaatagtttgacagccttactccttaggaggcactggcaagtcatcagaaaattggctgagatcagttgagcccagtgtagacctgcaggactgtccacctcacccttagacttgtgagcagtaatacatgcacgttgttctaggccactgggttgggagtggtttgatctacaacaacagctagttgatgaaagactgtgtctacaagtacaataatatgtaacacaaacctaaaatatgtggcactggctctaggatcaggtagtaagcaaaggctgataattgatgcaaaagctaaaaagacgataagtgaactattatcaaaggctgaataatgaaatgatcatgtgtgctggaagaatggtgacctgtgttatgcagcagcaaatgtaaaactgttgtggccaggtgcggtggctcacgcctataatcgcagcacttcaggaggccagggcaggcagatcacctgaggtcaggagttcaagaccagcctgaccaacatggagaaactctactaaaaaaacacaaaaaattagccatgcgtggtgacacatgcctgtaatcccagctactcaggagactgaggcaggagaattgcttgaacccaggagatggaggttatggtgagccgagattgcgccattgcactccagcctaggcaacaagagagaaactcagtctcaaaaaaaataaataaataactgttgcctgtggtaaatttaaagtaagataatatacctaatggatttatgaagtatggtaagataagtttttagatattatattcagaatgtcagttggttttattgcatgtgataaggtatattgataaggagagaatcaaaacagcactcacccatttgcaagcagattttagagggaatatagagaggccaaggattgctgagttggaaaataaaattgtttttccttatagtcttcccatttggcaaaagatcatgtaaaatgaggcttaaagactatgatcaaattaaggctgtggccgtaaaaccctttgttaacacctctgaaagaattaagtggtgcccaacaggggaaaggaaaggggaagggtgcttctagaaatcttaaagagtggtcccacaaatgtcaaatccctaaatagcagtagttaagtgtgtacaaagaagcattcttgaaaataattgtagtatggattttgcagcagagagtagagtataaccagacttaaagaaaacacacaaagttttacagtaagtttcataggtaaaatagccatcaactaaattgtctgcaactttctataggaaagaataagtctaagaaaactaatcaggtgccaaatagaacatttcttcagaagtggcccaggaaagtgatagactacgaaggtcatcatagagggtagagcaaaagggtaccatgtgaaaaaataaacagggaagttactcccaaggagcaaaggcaggatttaagaaacatttcctattctgtagatgagggacttggtaacatttttctagcatgatttcagaattactactgatcggtgattgctaggtagctcctgtttttcccctttttggagttacatctgagaagccacatcagaacttcatgtagtataggagaccctggaattaacatgatgttagaactggattcaatttctgggtttggattgggcatattttttcctttaggagagacatgtataactgagaccagggatggtagtctttgatagacttgagacaaaatgagtccatttttttacccttccctgtattcataacctttgcaatgggactttgcagctcttcttatcaaagggtaggctttttccctactctgtgaatttaaactgagacaaactgctttgaccaagagaatgtggcagaaataatggtatgctcattctgaacctcagcctcaagaaactctgcatgttctgtttcctctctggaaccctgccattcctatgtgagcgactcctaatttgtctgacggaggatgagagacgacagggagaagagtccacgtgatggagccaaatctaccagactactctacaggcagcaaatcccaaatgtgtgaaagagttcagtcaagataagcagaacaacctacacaattcagccctgacaggatgcataagtatactcaagtaataatacatgtttattatttgaagccactgagtttggggctggcttttttttttttttttttttgcagcagttaacacatgcaatgatcccctgcaaatatcaactgcagattaactaacatccaaatgttttaaatatctagaattaatttcagcaatcctctctttaaatagagccaaaactagataatcattttaggttctttcaacttgactgtgtttttcctgccaacataccaaggaaatgatgagatttgtcaaagttaatagaaaatccactactgcaatagaagagtatctgatttttacttaaatgtttccatgaataagtttacaatgctcaagtaaagaaggacataacccagagagacagcaatcaggtcctcgaaagttttgggaatctgagtagtattctcataaatatgtacatgtatctcttcctaattatgaaatatcttgagcaagcagcccaaataattcttgatttttttaaatacttggagccatataatatacaggtttctgaaagttgctgtatgtctgtatgtatatctttgtgtgtattaaacaaaaaaattaaaaaatttccttataatgaggccatagacatgggacccaggaaaaacgaactcgtgtcctgaatgtgcccttgccagagtttatttcaacgtgaattgattctaaatacacttttttgcaagcattgcccaacatcattatataggcaagaatttcacacaaatcactgattgacagaaaaagaaattcactcttctcttttattgtcattttagaagatacattaagatctgtgatgataatgtaagaactttaagtattctttcacattccaagcttagtcattttctttgtaatttagataggtgaacagttattgtgatgtgaaaattggaataattcaattataaaagctaaatttctgctacaagatgcataaatgctccacattttttgctgtggctaaaaactgattttcatgcatgtagggcttctaaacccaaaaatattatttcaaaatgcatcttttccaaataagaaaaaacccacattagtctaccaggttaaatgaaaaggctaaatgagagagctcttaaatatagcaaaacaaattttacaaaacacaattttaagatacaataaatatttgtcatattttggcaataaaataaatgggaaataaaattatatttataatattaaccacgatataatcaaaaaatctccacaaaataaagaaaaaaacacataaaaaactcgagtattaaatttaaaagtgaaaatttcatttggttttccatatgagattacaaaaagaaaggcatttactaagatataacttataagaggactttctatagctattcatctttctattgacagaatatcccagattctttacaaactatttagaaattgctgggtttgcctagatttccattaagtagcagtattccacaggaaagaaaaggacattttggaaggaataaagtattctttggcataatgattttcattcccaaagaatacaagaactggatacaattatacatttttttctaaggcaatggaaaagtaatagtcaacaaggtggtaacaggcttcttctttaccttgaaaaaacactatttttaacatttttcaaccagagaataatctctatcatgtatttgagttgtgtaacaccatttaacatatcatgctggaaaacatttgccattatatgatttcattttaaataattataagatgatttgtggtggttaaaacactctgttttttagattagaaaaacagtttcgtttcactctaaacattttcaaagagtaggacaagatctcagaactagccctcaaaatatttggtggaaaatatttcaaagtgaaatgtgaagttgatttagaaatatttctgttaaaatataaatacatgtactatcaaacttgaacatattagctgcttattctacctgtgaaaacagcttaaaaatttgcaaacattatctccataaattattttaaaaatcactgtccaaagaaataaaatagaaaattataggaaacatttaaaagaagttatctttccacttcggaagtaccatttagggtgggaatataaggtggtgaggacatgggaacaaatcagtgaacaaatgaataatcaagatgatttcacctgtgattgtgctgtgaaataaacaaaaaacttggagactgatttatagaagaagagatcctttagattaggtagtgaggcttttgcataggaagccagtatttacactaagcctgaatgatattaaaaagccattcaatgaaagatctgagaggaagggcattttggcagaaggaactgcaaatgcaaagggccagtgctcattaatatgttcatgctgtgcatccacaactaaactgcaacctgcctaagtttgaagctcgcatgtcctagttgtttggtgtaaagattattatcagtatgactttaccatcgcaacaattaattcataaaagtcttatttaattaaaacacaaatttggccactttacaggggtatgatatatgacagcacatactgattttagctgttagaaacaaataagatgttatgatttaggtaatgtaaacaaagaaatgcccaatgtttttcaataaattaattcaataacaaaactcaaagccttttaaaaaaactttccatattttcttttctatgagtaccaagattttccaaataagaaaagggaaaaaaaaattttgaatagtgaatgctctgcatgtaaaggagaaaaactgtttggaatgtaaagatattaataactgtagtgactaacactgtacatgagaacaaactgttttcaaactgttttgagtagctagaaaacatactaagtttgcgtaagtgttttttgatatagattccatacaggctgactagataatataacaattacttttatttcattaaattgggaaacttcataatcctcttgcaaataaaaaatttcattgtaacaatttatttgctgcacacgtctctttcaaatattttattttttaacatttactagttccttaatatatcttattataatcttaaaatgatatgtgcacacatatacacaggatgtgtttgtgcatatgtagctaaaacagacaataatatcataagtattataaactagtcattgtgaaaaaattcaaatgtttatctaacatatgaaaaaatgtgtaatctagttattaaggaaattaaatcaaaatgtacgttttctagcatgaaatttgctaacattaaaaagaaaaataggctggatgcagtggcttatgcctgtaatcccagtactttgtggagctgaggcgggtggatcacctgagctcaggagttcgaggtcagcctggccaacatggtgaaaccccgcctctactaaaaatacaaaaaaaaattagccagttgtggtggcatgcgccagggggtagtggaggttgcagtgagccgcactccagtctaggtgacagaacgagactttgtctcaattacaaagaaaaaagaaaaatattaattttggaaagtaaatgagaaataagtactttaatatgctgttagcggctgcatcaacttcaatgagctatttcacatttctagtaaaaaatacttctgcctttttaaccagaaattgatctctagtaatatatcctatagagacatgcatatatgtgcacaaaaagacatgcatacagatttatttcaaataaatgaaggagatgaaattaacaaaaaagcatatttttactgtaaagcagtatatcttatttaaaagcacacattctaaagaaagaaaattaaatcatggtatgattctgaataataattgtatatgataccatattcccttacatctgattcaaaacagctagatgaatgcattaatcttctttaaaactaattatataacccatatttggggattaagaatgtttctgacttcatctgtcaatatgatagacagtacgttagccccacagattttctaaataattacgaaaacattcatatttaatggataaggaaaaaagccattgctgtttcaaaatgaataacttgtgtgcttgattacatagtctaataatttaaagcaccttttgttttatcttacaaaatatattataaaatattatctgctacatggtcttttcttatgctcaacttatttccatttcttaataaaaggaaaaggctataaaatttagtaagtagaaaaataagtaaaaggtattaatattctttcttgtattctttatcatattatacaaaaataaaagataaatctttatttatcaaagtcctctcactttttctgcccaatgatgttgtcttaaatttttttatctctttaaactactctctgacttcctcattctcatcagggaatacaaggaaaatggagaaaataagacaagactctcaattttgccactcagcatcctctgtattcaataactacttcttgagtgtcctccatagtcttaggcactgcacaaggtcatgaggatacagcaggggatgagtcaaatccatgtttgaccttaaagaactcagaaattgtacttctttctttcttttattaaaggaaaagttagctatccagcctgttcagttaacaacagcagtattccacctctcatcctatcttctctccacagaaaactgtagagaagccacttgaatttggagaactccacagtcatctataaaagtataatttcaatagatcacattgaaggcagaagtgtaatttcacaggttggaagtaagcatttgatgaggaaacagatgcattgtttgtgtgtgcagatttgttcaaaataggctgacttgtgaaagaaagaatttaagtagaatgataactagggagaacaggaaaattgagccaaagcatattcagtatagaagaatctcatacatgcttacaaatggaggaaactggtaagtagaggagaatggagaatctagcataacaacaacaacatacaaacatatacatgagggaacaaggtgctgaaggaggtaaactagtttgattgaaggcataccttaaaagtaaacttacaaagaatagaaatatttcttctaataaagttgaaaagctgagaggccagatttctgaagaggatggatggtctctgatagagctctatacagatgattttccatggcctctatgatttttcatggcctctgcaggagattcacttggagagtagaaaatcaggaatctaaataattagctagctaagaaatttaaaatttgttttgaactaactttttcagagccctatggaagaagtgtgagttttattctatctctaacaatggctctgaaataaacactgagttcttacaatgcctataccccgctaattttcaatagggtaacttatgtattcttacatcaatcctgggaggctaatgctatttatcaaatgactgcacaaatgagacaactgagccagaaagtggttcaagtaaaatttgaatccaggaaatttaattccaacactcttaatcatgaatatatatttcctctgagcttatttccacaagacatattaggatattagtaaataagtttaattcatatttactaatgatacaggagaagggcagggaagtgctggcagagaagggcattgtccccggtgagggttctaccctcgggcctgtggcccacggacctaagtgagaacagcactcctattttcacgtccgaatgttccattttccaagaccactctgacccaccatgctccccccatcctgtgcctataaaaaccccgagacacgaggaggcacacagacacaggcagctggacattgagtggaacacaccagcagaaaaacacactgacagacactgtgtttgccatcgatggcagaacgacacggccatagatggcagaacgaagcggattacatggaatttggctgagggtggttggagaagagcccagccactgagctgcccaactccaggggaagaccaccttcctactccatcccccttctagctccccatccatctgctgacagttacttccaccactcaataaaaaactttgcacccatcttccaagcccacatgtgatctgattttttcagtacactaaggcaagaacccaggatacagaaagaagcccctctgtccttgtgataaggcagaaggtctaattgggctgattaacacaagctgcctgtggacacctaagctgaaagcacactgtaacacacgttcactggagctttgggagccgtaaacacccaaccctagatgctgccgtggggtccacattccccactacctgcccatatgcatgctccccctaggggtttgagctttgggacaatgaagaagcaagccacaccaccgttgcatgccctgtgagggggataagagaacgtttcctgttttacctggggctcatccaggatcctggaaggagagtatgaatgcaaaactgtaggatctgccactcttccaaaacactgccacctctctctctttcctgtgagtaaaaggatctgtttgccctcatggagttttaaccaccctaaccaggctggttaaacaccccagacttcgtctcttgtctctctctcactgtttgaaaggctcttatctcttcctttatgatattaagagttttgctagaggctgtggcaatgttactaggtaaaatgagcatttcactcagctgccaaaggtgcaaatcagaccacctgtagaggtacaccgactcagcctctacctaaaaagccacaggcaagtatggctctgggtatctacccttactctttcccctcccatctcgggtgcctgggcatgtccacagcatgcaaaggccatgcccaacagccacctttaaattgctttgccattttaaggaacacatgaaatcacattctactgagagtttcaagtgtgaaatacgcaataaaaagtatcttctggagagcacacggaaacagcacctaaattgaactaccctgaagtagttggtaactgggaaagaactaggaaaaaaaattcatgtatatcagtactgtgggaaacggtttgacgattttgaacattttaaagaacatctttgaaaacatacaagggaaaaaccttttgaatgtccaaatcatcatcaatgatttgctagaaatagcatcctcaaaggtcacctcactgcatgccaaactggagtagggacaaaaaaaagaaagaagctctatgaatgccaggtttgtgacagtgtctggggtttatatgtagattatcatcattatattgccagactcatattattatctactattttaaaaatatttgtcttttatattcacttgtactctcaatttctaaattgttttccattcaagtgtaaaatattttccaggtttttttcctaataggttagataaatggtatattttctgaacccctgaatgtctaagaatatatttatataccaacatacattaactatcttgcctctacgtgaaactgttagcccacaacataatttcttttaaaattctgcagacaaaatttttctattatcttctgatatatggaagtgaataggtgaagccacctaaatttccccccctgctcttggtaacctatctgtcccttttgcctacatatttattggcaggacttttcttaattgctgtagtataataacttgactagataatagtaaactaggaaaataaatcatttggagttatacattcaggtaaagaaaaaactcttctatgacatctctgattattggttatacttatttaactttctctttggggtatacctatttctgcctccctactctcgattcttaactctgctctgtttttactcaacatgttatcatctcccaacatattatatatattcttgtgtcctaatgtttataatctgtcttcctcctcaggatgtcatctttgtgagagcaggtgcaatgtttgctttgtttattgctgtatttccagaaaattgaatgataccatagctagaatgcaaatagttttttagtgaattcaagaaatcccacattgggtcatcatttatcctgaatattactgagtttgtctcacattactgtatcttaatttacatttagaattttaaaaataattttctatgatgtgtttcattttctgttaattttttcatttttacttacggtgggtgcatattaggtgtatatatgtataggctacatgtgatgtttgataaggttgggagggaaagcaggtggggaaaggtggggatggttaatggttacaaaaacatagaatgaataagatctagcatttgatagtacaacagagtgtctcacataattttaagctttatcattttcatctgctttatcaagagctgatcaaatttcttttttcaccactgattgtatttttctttagctataattctactcatgaatgcctgcaaagtggagtttatttaatgtttttagattcttaattctgtcttacctctttcctttgttttatctcagtctatattttgctcctttttcaaagaagtcatgctttcatgaactgtgctgaagtcctaaaattacgccaaggtgtgtccatatctctgaagttatcacaaaggttaatatttttcagtatgctccaggatgttagaatatagtgcgtagtagttgcaggcactgctaccagggttcatctgtatcatacaacctgcaagtctttattttttgaggtgatcctcttaaaaaggtcttatgattggattattttcccaagacgttctctctagtttttctatgcttttcaacatctgcctgcatgtagaagaagaagtagtggagacccaggaaaaagtcctctgttttgcacagacaatctaaaaaagacagagaaactgatactcagcttcctcattaacacaagtgtaaattctccaggcagaggcagagtattgaagcattttccttccttggtcttaggcagtctacgttttggagcacaacaatttggagcacaacaaaaataggaaacctgcttaaagttttcttatggaaattctttttgatgtatacttagtgtatttttctttaggactttattaattgtcaaaattagttgttactgttattacaagtttagacattttctagggtatttgagaatacataaaggcgcaaagctacaaacgtgagttttaattaaagtagtattcaaacttttcgacaaaagttatatactctaagtgaaattatctaaaaatactataggaagtgtggatatcatttaccatgatggaactactaataactgcaacaattatttatctgtatgtcttttcttctctgagtattcattatttactacctaacacctagttgtaaaaattttaaatgtttcgctttttcacccagatcatttataacattaaaacttttaaaaaattaatatactccaggcttttaaatgttatgtatgtatattttttcacttaccatagagacaagattatttagtcatgaaaatgactatccattcacttatgagcaactacaaagctgtttcttgcaaataaggccaaagagactgcaaatactcaaggccacactaatttctcttccctttgaaaatctactgtatgttgcttacttattagcaaattcataacacaaaatattctgtggataaaagtgccagaagggaccttacagatgatcaagttcaatgtacaaatgagagactggaaccacagaacttttgacacctattcaagatttcaaagccagctaaccctagaacacaggtcttcccatttcttatctagttttattttttcagccaaacagaaaggtatttaaggacagatatcatgtcctctgggtcctagtaacctcctccatgcacataatattggtaggaaatttaaaaatgctttaatgttgatatatggttgatgatgaacaagacatgctttttggttttttgttctagcttgactgtgtggtgaagtagccattatgtactaacctgtcatgtggcaaataaatgcgacaaccctcaagtttttctcttaagattacatcagaaaatagaaataggagccaggtgtagtggctcacacctgtaatcaagcactttgggaggcctaggcaggcagatcacctgaggtcaggagtttgagaccagcctggccaacatggtgcaaccccatctctactaaaaatacaaaaattagccaggcatggtagcacacgtctgtagtcccagctactagggaagctgaggcaccaggacagcttgaacccatgagacggagattgcagtgagtcaaggctccgccactgaactccaatctgggcaacagagtaagaccctgtcaaaaaaaaaaaaaaaaaagaaagaaagaaagaaagagagagagagagagagagagagagagagagggagggagggagggaggaagggagggaaggaagagttaatatattatttggttataataataattagaaaacatctcaaaatttagaaagcatacccataaacatcatctcattaaattcttcaacagtcttgtgtggtaaacattatattatctctaaattattaacaagaaaaaaaatccagagcccaagtaactagctcaagtttgcaaagctaatgagtgagaaggtaagaaattaaacttactctatttcattaaaaagcttaaattctattacttctccatagactaatgctatttattaaatcctgccaaaatacttctgcattcaatgctaccaaagtcaaagttataactattacacaatattcaacaggactataacctaaaatgttatatcttaaaacatgtaaactcacttactacttaaatgtatcaatgaccataacaaaaggcatttattttcattgctgtatcaatatatataggcatagctagggtgaaggaaaaggttttattttatgcagcagtaagtaatactgaaaatcaaaagagtagtatctttgataatttcacacatattacctaagaaatagctgctcaattttcctcaaaaaaaatctacagggaattttcatacagagctcaaactagctaaggaaccacttggttcaacaagctctctttctatactgatggttagcattgaaacatactgccaccttatgacaattctttttatatcttaattttcagaatattctgttataaaaataaaccttcaccaggaatatagccataatgtctagaaattatctggaatttatttgagatttttaagttattagctctattgaaagcaacctgagagaaaaacactacatttaaaagggtatttttagatttggaacaaaataataattttgacatggtttcacaaggatttttaaatccaagaatcaggcatataactgattacatgctggcaagtaacctaaaatttagaatctatttttccaataacagtttaagaagttatattcaagtatttgcccttattgtctctataattttgcaaacacacacacacacatacacacacacacaaagacttacaagctgcaatagcttagatttgaagaaagtacagggaaaataaagactaaaattgaaaaaagactgtaaacataaatacactagtgtgtgaaatttacaagaagacaaaataaaacagtactacaaaattactactactacaaaataaagtacctgtctacatataaccctctttttgagtatccacagtagaaatttccattgcaccatgaaacatgaagtttttatacaggaactgatttattcttctctatggatccagtgattcatgtttgtaatgggttctctgtttccctttttgcattagttgctaaagtacttacagaataatttattttttatctttatcaagtatataagaaatcatggcgtgcattttgtacagtattatcactcctggttgcatctttttttttggccttattttcactttggcctggtagtaccatttactttatgtaacaacttgtttctatggaaagataagaatttagaagttgaacaactagaaccaactctaacttttactagctgtagggccatgatcagttacttcatctctaggataaattatagattgtctattcataagttgtgacaaaaaatacctttagagatatctaatatttattgggtgcctaatatataatggctacttacataacttaatttctacattgtttgatttcagtgaagcttctaaaatcaagttatgttttataattacatttaatgcagttgtgttctcccacaaaagcaatttttaaatcagtgatgtcttggaattgaggaaaaagagtattaacttattgtactgtacttttgtaatcacctttgtgttcttttcgaattaagcagaattactaacaaaaacatttcagtaaaatgctcagttgcagttaaatcataaatggggaaaaattagaaactgatgaacaaataaaggctatgattaagacttcgacattgttgttttgagaaaaaagttgacaattcagtaaacttttccatatgtcatgaacactgaaaattcactaaaacttgtttaaacttcatggacaaaagaacaataaattttttaaaaagtcatgcacaataacataatgcttagtttaattactgatttgctgtttgcccaaagttttaatcaagagagttcttacatgtggataacaatgatgacatctgtaaaagctagtgccacgtttaactcctccaggcactacagcacctggtgacgccacagggaagaaatcatggatacttcttgaacatactgcaacagctgtcaactcagaaggaggtatattctaagttctaccaagcaagtagtactctacaaaacctcattctgtcccttcttttaactgaaaagaagccagatggaaacatgcaacttgtcaaattgcaaatgaagaattactataaactgtattgcatggatctctgggtgttcaccactaaaaatttggtcgctcaatttgcagagtaatttcactgacatttaaagaaaactaaagatgcttgatactatttcagataaagacaatatcatatttttaagagaatacagcaaggtaaagacaatgaaaatatgaacgtatctttaacataacagcagaacaaataactaacaggcattattctagaagcttcataatgtccagaatgactacaactgcaactctcacgacagttaatggggcaatctgcttggagcacacagccacagaaaaccaagaaaacaagctgtattactcatgatacagcagtcttagctacactgctatggttggctaaacctccacctgtatcttcattatagagttctatttccatccactgtatgtgattactataaatgtttaaacattttgaggaaatattcattgtaaatgtatacaaaagtaaaaactaataaatttgctttatacttttggtacaaaaattacctatgattttaagaccaccatttgtttgataaaattagacatatgtagttatctcatatttagagtgtaagcattaccatttctgagatgccccagggaatgttttgatttgctcatccattcttgtatgtctacatatatgcatccattgagcacctactgtataacatgttccatgcatgtttagttacataaagacatcctttcaacatcattaaacccttctttaacaactagagtcttgtttagggtagaaaaaatgccctgcaagttctgaaacaaaatgatttatatcaacctgaatcacatcctaaatgtatatgtgatcctaatgatgtgataaagatcactgagttcctgagagtatccatgaacacaccttccaaaactgtggtacaaataatttcttagcagctttaaatgatagacattatttacctatcttctaaagaaaccctaaaaattatacaaatgattttaacaagtcaactcacattttttctataccaataatgcattttaatgtggttaatcagcactaaataatatttcaaatgcttataaatttagatacagcttagctcaataaccacaccatgcatgtccacagaggagaagactgagtcttagcaaaggttgagaaagctgcttaagatcacacagaaacaggatatggtggttctgactgattcactttagcgtcaggcctgtgtctcattccaatcctttattctttggtaaatctcttagaccgaaaagtgcaacactggaaggtattagtacaaggtaaccatgtagggacagaaagataaattttaagttgttgaggaagtaaactcagacacctttttctgttctctctcttcctcatcctctcacactaatagatacatgattaaaccactgcaaacaaaggtctgtggaggatgctttgtccatactgcctggttcacttcacattacataaatcacggcgcagagctaccagcctaaaccacctctgttatcttcatttctctacagatttgcctttctttcaaacccactatcccattttcttctgtggccccagacagctgtctttgcagcacaacagacagcagtcactgcagctttgctttgagcatgttctacagaagtccacatcccttgcagttgcctttcctggatcatgggaccccatcacagtgagctcttccctatctgcaggtagaggactaagaattatacatttgctgggggcactgccatgtatactcactttacttcccattttactaaactgtattctaattttattcatttccctgtttagatttaaaacgttcagtaaaagcacagaaagtaaaagtagtataaaggcaagaccagtgaatgaaaaacaactcagaaattgaccacaaattcagtgctactttatatgacaatcccttctatctttaatagtattaatcaaatgtcttaaatcatttataaagagtaaattattttcctttgatacctttgacagaataaatggtcaaactcctttgttacttttgtctgtaggagtcaggactgagaaagtattctctggatatcaggtggtggtatcatcagggtgataccatggttcaccctaatgtgagccatgtgagccgacatagtgaaggcacagtcctaggggaatgtgcaatactgtggtgggcactggagaattctgaaagcatggggtaggagtgtgttggagagaagcaccaaatgctagctgttataatccctgtgttactcatctctcaaatgtcccctttctatttcttacagagccaacgctgttgaacagaaaaggataaaaaatggatttttgaaaaaactattattcgaatgatcatgactataaataactggcctcctccaaaatgaaaaagaactccatgccctagttgtacaggaataggtattgatcatcctacttaaagtaatacttttatacaagatgacttacaccacagaaaatcagatgtgctttatcgggtttggcaagtagggactgctttcccagggagatgtttccaaataaggaaagaatacagctttgttattttattttattttttatttatttatttacttatttatttttttgagacagagtcttgctgtcactcatgatggagtatagtggtgtgatctcggctcactgcaacctccacctcctggattcaagtgattctctcacctcagccttctgagtagctgggattacaggcatccaccaccacacccagctaattattgtgttttagagatggggtttcaccatgttggccaagctggtcttgaacttctgacttcaggtgacccacctgtcttggcctcccaaagtgctgagattacaaggtgtgagccaccacacccagccttgttattttatttttaatcaaagtaaggaggcatcatttaccagaggtcatgaaactggaaaagacaaaaaaagttgcagattcggaagacaactcattcagagaaaggctacacctttcttatggtcagtaatttattctaaatcccaagtctaacccaatatcatggtaacagaaagcatcagcttttccctgaaatctctcatgcttccaataaaataatggttcccatgacaatagatgctacctcagcagaggcaagttcagagtacaggcagtacacatatcttggcttaataagcagggaggaaactacactggcagtattatcctctcactttctttttgctgttagtaatagaagtaataggttataagagatatgaatcacattatcagccatctaatatgcaatacttgacttcatttgattttctattccaaagagactgtcagcgttcaacataggaggaatactaaaaagcaaaatgggagacatgacgattcctgctaattgccattcattacctctccaaacaacagtgtttccttagatataagccatgcttttcctttttttaaaaaaaaaaattactcttacagtgtaaataaaaccaatttctcagcgctttataccaacagttgagagtgtaggtatctacttagtaaccaagcttccctggcaagaagctctaggggatatatgaagtagatctctagatgaagaggacataaagaacaagagaacacacttaagtctctaagtgttttaaacaaatgtaaatatatgtagttttataagactaaactatctttctgaagaagtgtagtacaaaatgttctgggtggttctcatttaacaaaataggcgattactttaccaagaaaagaaatccagtttatatttcctattactccacacaggcactatggaagcactctctctcataaatgatctgtgttcaaatctacctacctctctcctatttccttttcagacagtctcttctaactactgtgaaaaacatgtgagggatgcatattaccagattaacctgagttatccaatgtgacattgtcatgagactgtgatttggactgtcatctatatcaacttcttaaggcctccattttttatacagttaaatagacactaacaaaggtagccaatacataaaattttatgtccagaagaattttaatgacaaacagatgctaggaaaacaattcctgccctggttacttttgtgtgaggatataatgtgcttaaaagcaagaaagacaataagctatttgtaaaatataattttttataatttcatggtgttctgattttaataaacacaaataaatttattaatctttgctgtctaatgaaaattattcacatcctgttgtttagtaaaatcattaaatgagaatatagctaatacaaacttttatttgtagaaagagaaaaacatagcagcatagcaaaatatacttgcattttgtataagcttcaaacaccacaaagtccattgaacgtttaataattatgcatatttcatttgttattttcataatgtataacatataaaagtactttactgaatatgagaaaggtaaaaatctatctccctgagatacaacatgcaccacacagatttcttctatctgtgtgttcttcatactgtcatacaaatcagtttggatcactgttttatgttatgcatattattcaatttgaatatatatttaaagtggtatttcacaaatggaagaaaataattacttacacacatatttgtgatttgaagctttcaacaggcaatgacactcatccatcaacagtcttcaatgccgtatgtttttatagcagttctccaaacatgaatagaacctaaatatgcagtgagtttcaagcacatcacacaccctgtgtttattaatagatctttatgctggccacaagagagattatctttttttcttttgggccactgactcttttttttttttttttttttttttttttttagacggagtctcgctctgtcacccaggctggagtgcagtggcacattctccgctcactgcaaactccacctcccgggttcatgccattctcctgcctcagcctccctagtagctgggactacaggtgctggccaccacgcccagctaattttttgtattttgtagtagagatggggtttcactgtgttagccaggacggtctcgatctcctgacctcatgatccgcctgcctcggcctcccaaagtgctgggattacaggcttgagccaccacgtccggccgggccactgactcttgactgcaatgatatcttcccaatttggcctttaaatcttgggtcaacgatatgcctcagccaaattaaaaaaaaaaaaaagaaagaaaagggattcaacttctctcccaaaatacgcaatttaagacaatcagaagatgaatggcaattaaatcacattactctaaaaagaacaagggcaacttttagaaaagcattcctttctcttttacatgtttattattaaccaacactttaccaattctaacaaacttgatgattggtgccctagaaaatttatatttctgatgaaattcatggattcttttaacgtacagatgaaaacaagtgtgatatgtaaaaatgtggacatttgtgacgtgtaattggccttcacttttacgcaaaagacatcttccttacaaatgattttttttaaagcacaaagataaaatgtgcttagtccactctgaattattgtaatgttctcatctaaaaccaccatctatcaaagattatcttattttataccaaaggaccatccattcaatatttatccttctcatcctggaaatgtgctcacacacaagatgagggccctacctgaggagacatttgtataagtcattttattagcttgtctctgaataaaacagaatagacacctgaagtttacacctaaagagcagcactatttttaggctgaagagtgtgatttctgaaggccaatattaaattacacattctgaaggcaatgagttaacttatgttatcttggcaacaaggagttattacttattttgtttgacctaaaaatagcaaaaatttgcaaagggaaagcttgttaaaatatagtatatacctgaaagaatttgggtggaaataaaaagctaattattacataactagtgagggagaaaactgtgtaaattgttctccttttgcatggaagttcctaacttctagactagttagccattgcttcatattttatgctttatttctctggctttgaggaaaaaaaaccacaggtcactgtgaactaagaacagtccttaaaatattcatgcattctcctattttccatacaatagtaatgaaaaaaattgaacatttggtcaattacagaaaatactactacaattttcaagttatatatgcacacaaataatacctaaattcagaaagaaaataaagcctctcatcttgtttcacagatttcccagtaggatacttgatattggcagtgaaaatatttgaaagcataacttaataagccacaattgcatcaacatctaaagtaaaatgaaataagtgagacttttatcctaaacagtgaaatagatcataatgaaaacactttggaaataaagaagtttcaagatgctatatcacaactgctggcttaaattgtcaacctgcatttctagcctgcatttagaataatggcagtcatccatggcaaagttcccctgctagtctgtaatacgtgaagaagaagaaagaggtctatttacaagattcaacttaccgttaggcagagaagtagcaaacactttaaagaataattcttggcaaagactgcaagtctaaggcacaccatttaaaataatgatccttctgcaatttttatgatgtcctccatttgttcataaaaaagaaaaaaaaagctaaatcttaagggaaattctgaacaaacagaagttccgtcgaacaaggctataacaataatagagcacttttgaaaactaagttaaactcaaaatcctcttttctgaaaagaggtgaagatatttacatgtaagtgctaaaatataagcatatataaacattgatattaccataatcaacaacttcaacataaagatcactctaccattgacctttattggtcacctgctgcatacatataagagacaagatttagtaataaagcttcctctagaaaaatcacacggtagtagagaggtagacaggttaaattgccattgcaacacaatgtgaaaactactttatttgtaataagtggcagctttacttcaaagatggtgccaataaaccctcccatccctgtatgtccgtgatatttatcccatgaagatatatagagagctgcaacagcaatccatgaggtatgtgcaggacgtggggcagctttggggaagaaacaaagctacagaggaggcacattaacagagacttgggaccttcattcccttcccttgaatctggactactttgtgagttccaatgacctataaaatgatggcagaagtgatgctgcaccagttttgaacctggttttaaagaagcttggtaacttccacttttgctcctttagaatccagacctctaggctgtaagatattagtttagcctaccaaaggaggagaagccatatgagagagaagaaagatgccagataccttagctgacgatcagtaccaactgtcaactacatgagagaccatcttggtcctgccagcatcagcggcgctcccacatcactgaaatagtttgaatgagctcaagcaagaccaacgaactacccactgagtccagccaattgacacaattgcaaaaaattataagttgttattgcattaggccattgaggtttggaatggttgattatgtagcaattgataactaacatgaagtgagaaaaaagtgatcaaggagtacataggcctatagaatccaacctgattttcccaaggctaatcagctaataaaggacagaaaggcaattcccctgaattctcatccaggattgaataatattgcaaaggcaaaaatacaagctgtattatttttcttattgttgttgttgttgttgttgtttgtttccaagcaaactctggctctatggcccaggcaccatctcggctcactgcaacctccgcctcccaggttcaagtcatcgtcctacctaagcctcctgagtagctaggactacaggcatgcaccaccatgcccggctaatttttgtattttttgtagagatggggtttcaccacgttacccaggctggtctcaaactggtgagctcatgcgatctaccgcccacctaggcttcccaaagtgctgggaacaagctgtttaatgcaaacacctgtggctgaataaaaccttaacccaagaaataacctgcactggggtacacattagtaccttcattcaataataaattcatagtgacccagaatctggctaatgtccacataacagccctaatttgagtataaaattaatctactaattacccagtattaaaatttgaaagcactatccatatattacatatttcagaagcaaatataactaatcacatgagctgaccctccctcagaaatgctttatatgagacacagtttaatgatatggcttctgactatactgggagcatcaatcatttaacagcatttctttcttttgcaaaattgaatcacaagctattatttgcatgtttactattgatcagtaagatacaaaaccctgcatggtgaattctagtagtttaaattctgggaaatagtttatgaaaatgaattttaggctttcaccctcagaaaataagtcatattatttattgtagatgataaggaaaattttaaatagccttgttttttctgtgctttttttctcacctcccacacttccttccaagcccatatgacctcatgctggcctaagttcctttgctacttcataattttctcaaaagcagtatttgaataacaaaattaagaataaaataaatatgtcttcttagatatacctcctgaaagactccgtgtccacaaatcactcagctcccttcctcaaatcaaaatgctcaacctctgagtacagctgatctcagctagttattagcatgcagctttaacacaatatgattaatttatatactgctttaagtctttgatagacttagagattgatggttttgaaaaacaaaaaacgaagcccttcaagattgcaagggagaaatatcaagttaaagaacagagaaaaaccgcaaagcatcacttgaggtatttgtgggaggtggggcagctttggggaaggaacaagtctaatgaggagccacattaacagaaacctgggacctacgttgtaaacttttcatctacctccctcaagaaatcatctggaatccccacactgcttaccattttctaagagcaaactctttctggtattggagaaaaatgatcaattctgtcttaaagttggcctaggttcaaaacgaatactcttcatggacccagctgacttcaagatcacgtgctttttacacagaaaagttgctgctaaaagaggtcacttttcttgcataagaaagagaggaatgatactaatattttagtctctaatagttatttcttaaacatattgaaaaggatgatacaaagcccagaaggattctacaccagacgaccctagagagaactgattttctacagaatttacacatttcaaacaaaaatacaatgttttcatggagggcacagaatagtctgcaacaatgtgatttatatggttctcttacttttctgacatttgtctcagaaaacgtgcttgaatacattctatttttctgcaaaatgtggataataccatatgttgaaaaagtaaaaacagtgtggttattttctgtgttctcaccatttggatattatttcttactctcttcacatctctttttcactcatctttagaattcttcaaaagactaggctcatgttaggtcacatattggaaaaagtagaattactagaaagacattctgttgagttcaaaagattcaattaggaaaaaaaatcaacagatgattttaatcaaatttgtaagcatgattaaagattatctacaattttcacgtccttatttgctttagtataagctgctatcaaaaataaatttccagttatctattaaactattgaaagacattttatgaatagataagttattctgttgagcttatagcttctttattaatttttacatattcagtaagaaaaaaggcagttggttcatccaaagttatgtctaaataacagtttaatacataatgtacataaacacagatttttctcataagacatcaggattacccacagttctcaagtggcatgattcacatttttaagaaatatttaatgcttcccttttattaaatgctttccacaacattgtgggatgtattgtatttccgaccccttcctatcaaatgtcagagaacctaaaaatcattgtgacaatcatttccaaatgtccatacatttccaaatgtcctccaaaagacaggaacacccagtcccccagttaagaactactagactcacaatatgattcaggaaggaaaacatcttcacaaaattaaaaccactgaaacctctgcttaatttggaaaccataatgatgtgcttttgcaactgtagcattagagtattggaacaagttttgtggtctaatgtagattcatactacaggtgtgctaaatttgtaccatgtgtaaattttttgaaggagtaatttgcatttttggtaacacagaatgtctccagagaagccatgcttaagtctagtaactaaatgtgatggtctggttgtgaatcagctggcctcagatacagttctttttactactttaaaaacttctttcttttgagaaaaagaataattaaatgctagtgtattgactaacctaatttatcctattcagtttcccacactgaggacagagaaaaaacaagcattttatacacctgtctaaagctattctgatcactaaaatttgtgcactcaaatatttagctgcaccaatattgtaatggatcttttttatgttacattgtaggaaaagacaaagaagtagaaatatagaaaggaagttagtaatgggtaaaaaagaaaaaaacccaaatattgtcaatatcctattgctctgcgaagcagagtgctcataatattttgagtttgagaaaccaattacaaaaaaaaactatatttttaaatgctttagctgatggaatggattcatacttcttaattgttctaagagaacctttcacctgctaactctattatgcatagtcataatgcagtaccgagtgaagatatttccattaacaactatttttggtatgcccattagacacaaggaaggacagtgcagtaagaagaccttaatcatagatactcctgacgccaaactagtcatatggccttgcccatctcccaaagagaaaaatactgctactgagcttttatttttttattttattttttttttttgagacagagtcttgctctgctgcccaggctggagtgcagtggtgcaagcttggctcactgcaacctccaccccccaggttcaagcaattctctctgcttccaggcagccaacacacccagctaatttttatattttttagtagagacggggtttcaccatgttggtcaggccgatcttgaactattgacctcaggtgatctgtccacctcagcctcccaaactgctgggattacaggcgtgagccaccgcgcctggccgctactgagctctttagtctgcatcagatcttcttaatgctaaatactttacacacatagttttctcacttagtgtttactgcatgccattatcattatctccactttacagatgatgaaactaagcctcaatcacatcaaaacgcccataaaatttcatgaaaataagagaatgacacttcatcttagttcttgtcctcccaaaaccagtaatcccactctaatcatgaggaaaacatcagacgaattctaagtaaggcacattctacaaaatacttgaccaatactcctcaaaactgtcaaggtcatcaaaaacagggtaagttggacaaactgccacagccaagagaagcctcagaagacataacacgtaaatataatttggtatcctggatggaattctaaatcagaaaaagaacattatgtaaaaactgaggaaatacgaataaagtatgcacttcagttaataataatgtatcaatactggttcattaatttgacaaagcacatttatataagatgttaaagataaaggaaactgacttggtgtaggtgggaaatctctatatagtgtactgtctctgctatttttctgtaaccctaaaactattcctaagttttaaaatatgttttaaaaaactaccatgctgagaaaaaaatttaaagtccttacaaaatggaaagttatactatgttcatgggtcagaagactcaattttgttaagatggtgattcacctcaaattgatatatcaagtcaacacagccccaatcaaaatcctagcagatgcttttagtaaaaatagacaaacttattctaaaattcatatggaatttcaggtgacctagaatagccaaacaacttataaaaaggaaaactaactttgagaactataactaactgatttcaagactaactgtgaagacaatatgataccagtgttaatatagaaaaaaagatcaatgccacagaatacaaagtccagaaagagacccacaaatatactgacaactggttttcataaaagtgcaaagtcaattccgtggagaaatgagtcttttccacaatggtgttaaaacaattggatgcccatatgaaaaaaacaaaaacaaaacaaaacgaaaaaaaactttgaccataactcataccatatataaaatttaacgtgaaatgtaacctagagccaaatgtaaaacacaaaactacacaacttctagaggaaaacatggcagaaaatatttgcaaccctagggtagacaaagatttttttagatatgacaccaaaatacacatcatagcacaagaaattgataaatttaacttcatcaaaaataacaatttctgttctttaaaacacctggttgttgtgtttgtttgtttgtttggtttgtttgtttgtttgtttgagacagggtgtcactccagtcgcccaagctagagtgctgtggtgcaatcatggctcactgcagcctcaacttcctgggctcaggtgatcttccttcctcagcctcccaagtagctgggactacaggcatgcgccactatgcccagctaatttttgtatatttagtaaggatagagtttcaccatgttacccagactagcctcaaactcctgggctcaagcaatccatcaacctcagccttcccaaattttgggattacaggcataagccaccaggcaaggccaaaagacattcttaagagaatgaaaagacaacccacatactaggaggaaatattttcaaggcacatatctgataagaacttgaatccataatattgtttaaactctcaaaaataaataataacagaaacaagccgaccaaaaaaaataaacaaatgtcctaaacagacacattaccaaataagacatacagatggcataaaacacatgaaaagatattcagcatcattcaccattatagaaaagcaaattaaaaacgttaaagactgatcatagatgtttacagttaacatatattacttccgttttgtttttaaatctctattttaaaaagcttgtttgacctggattccattcacctaagggtacatattatcaacatgacttactaccattgatatcaatcttgattgcctggctagttagtatttttcaggcttctcttctgtaaagttactcttttccaactctttacatattatacttttcggaaaaaagtcaccacgcttatttcacacttaaaaagtgggaagccatgcttcacttatttcagggcagggtacatagatttttagtacacatatctttcacatctttcacaagtcagatttatccctagtactgtataatttttatgctatcttaaatggtattgctttaagttttaatttttaattgtttgttgttagtgattagaatatatttgatttttgtatatcaatcttgcaatatacctaatcttgtttgttctagtatctttttgtagatcacattagattttctttgtagagaacaaataagagtaggaaataaaaataattttacttatttccaaaataataataatgtgagaaagcagtcttaactaatgggatgagcacagagtccagttaaagtcatacttctttatgtaaagttaccagtgttgggtaacttcaaaatgggtggcagaaaaatttacatgagaaaataattatttttaatttcctaccctctctaaaaagacatttagcaatgggaggcagtttactacatattcaccatatttaattcattcattcaacaaatatgcctagctacaaatttcatcaaattattttattctatcatgtatcaattttctaactgctaaaagtgtataatttatagtgttagaatgataaataaatacataattaactactcaacatttagtaactgatactaactgttagctatatgctgatcttgctaacagaatacataaaatacgttttaaaagcaaaataacatagaatggagactaaagatcataatgcacattgacgcaattaaaaacaaacattcctacataaactcatttctataattttacctttgtcttagcaacttcactttttgacatagtgaacaactcatatttcacatgtactcaccattgtagctttttaaaaaataatggacatactatacacactcctatattattttatatttcaatgctgaaattttaattaacatatacatatactcaataaaaacaataaaaaatatgactcattctctggaaaatttcattattaaaattactgttattttataatgataacatctcattttgttgtgccctaggtataatgaaacactctttttattataataaaatgcaataaaaagtgttcttccctgtgttactgctgttattttgaattatccttataaattttctgataatgagggtaggctatcatcaaaagatgcctccattaaaatataacaatgatggtaatagcttaaaacttgtattgtacagctgaaaattcatttgtacacatatctcttttcatccacataccaattctgttaggtgaatatacttaaccccattttacagatgtatccccatttatatgacaatgatcataatagcttaaaacttttattgtacagtttaaaattcactttcacacatatctcttttaatccacataccaattctgttaggtaggcattattattatcccaattttatagatgtaagtactaaaaagctaagttgttttccttgtcctaagcaacacagctaattagggaagttaatttttctccactgcttttaatcacattaaactgatccttctattcaacacatgaagttaacattctatgaaaataaaactggaatctctgagtctacattgatcacaaattgaatgtatcctctcaatacactgttttagtcctttatatctttgatagaagtgaacatcctaattatgcccatgagttacatatatgagatgccttcaccccacttcaataaaactctttcttaatgccaatataaaaaatactctacattaattggtaattgtgaaaagagactcagggagagagtctgaatcaacaaaagaggaaaatataggaaggaaagggaaagacaaagaaggagggtgagacagagaagagagaacaaacatccaggagtagtgatgtgaattatttgcttagttaccacaaaagtaataattacactaactctgtgggaacaatggtaatttcacagtagctcacgttactgttatcaccttatatcctgataactgtgaaattaatttgtggcactactgtatgtgtcggccataagctgttcccttggtaacagtattatgctaccatagagaaggaatgtttggcagtaaaatgggcagcagcaagctgattacacagggaaaagcttctatctaaatacacatagcataacaatcacccctggaaaaactacatggcttaccaaaagaggtctctctgttcactgtccattatctgttgactgaactagttcaaatgaataacaagtaatgatcaaattgccagtttatattttacaacagagtcttatctttaaaaaaatgcaaggaggaaatacaaaaatgtaatacatttatcttgctttcttttctatttcctcccctgaaattattactatgctattggaagccatacaaacacatatatacacaaatatacatatgcttcaatgaaaagcaggcatgcagctgacagctcggcaaccctgaggtataaacaaagataccagacatattttttgaaataattttgctcaaggaaattcatttcagtaggaagatcagttactctgctgtctcctacctacaaagttacagaaggaaaagttcaacatttggccaaaaggatagtagcttacatttcttttttttccttttttcagcacagaattttgaagagagaatacactaaaagggaagaacataactacatgacatcataagaagtcctgaattagaagcgtatatttgaaaggtcatgcatcctgagctgccaacagcttaacaaccagaggcagaggccagctttgccagctcactgcttctactcatctttcatgatagtagccaggctgaatatagttccaggatgataatgaattggctgggcatactgtttatattagtatgtatgttcctgtactaaaccaagcatcatgaggccagcactattttgccatttttcagaaaaaaaatatgaacccttcaaaacatagtaagccttttttaaagtatatatttgattttgaaataatcaaaatatatgtagggatatgactgcatcctaagatttatgataagttctgatgagtaatattttctttctacatgcaaggcaaagttaatagtaactagaaagtctttatttggcatatcatagatttctgtcaaccaaaacaactaactctggggaacataacgttctgacaacttcagaagagttaagtcacagacaaaagtttattggatcttagttggctcctacccaccaattctttcttttccaagtggaacataatagattttcaatatttgttaaataattgaaaaaatatcctcaaaattcttttttggccatcttcccaacaagaatatggtcctaacctatatgtagagtcctttgctgtgtcatctatttcttcagaattattctcctaattcatatgtctggatagtctctctgaattgttatagaaaattaaaaatgtgaactatgaaattaatttttaaacttttataaccatctagtcatacacagaataaccacaaatataaacatggtttcaaagaattccctgtgacaatcaagcaaatagtgaaatagtttctgctattatgaatttatcacttactcagtgtatgaccatgggcaaatatcttcacctcaatcctgtgaggcaggtactattattctacccattttaagtatagatttgcaatatttgttaaatattcaatatttgttattataaaatgagtatactaatagtacctacctcacagtattgaggtgaagatatttgtccatgtacgtacaatatgggcataataatagtacctacctcacaggattgttattaagaataaataagataatccatacaaagtatttaacacattattgaaaaattaaatgatcaaaataaagcttgttgttattgttatcttttaataaatgcatctaaagtatttttaaatgtattcacttcagttatttaaagtttcatctgctgtatcacagagcacatatatgttcagaaacatttgttaagtatctatgtaccagataataaaggtggtattgaaaaaagaataggcattgtaacaggcagacaggagtataaagtccagccttgccacttatgagactcccatcttcaaattatggaacctttctgaatctccattttatacctataaaaaggggtagacattacgtctctacttgcttcttatcattaaattaaaattcatattcctttctatggcaaggaaacgagtcctgtatagtcttgtaattcatctccctccaccaaacttcatccacactgacttctttaggccaagcttgttcctatatcaaggtgagcctggaagcctgtacactgttccacagtggtacacctcctctagccctatagaatgcaaaatggaagcacagagacattatacaatggttagccagtcacattacatcaagtaaaaacaacaagttaccatgaagtttatttattggagtggcttcagtatttcttgagaaacacaaatgatgaccctgatttgtatgatcaatcagcaagttttcaaaaaggttactgagtatatgacagtaatttctagagccaaagatatacccgcatgaataagctttcatcctgaaaaaaaaatcaccttctgaaactccatgctagttatctgaaataataaaggtgaagtacaaattatgtgatctatcataacctgaaataaacatatgttgctactctgtgatttggtctttatcccagtctgacccatttcttgagactgttacctcaagatgctctcccatggagctttcactgagaatactttaatccattttcttaaaaatccataacaaaattactaagatctcaatgtcttatcaaaacttttttttgtctcaaaaatgatacatgaaaaagataatcttcaataaatgcaggtaaagtattttatacctgcagcattgaattgttccactggagggtagcagggggaaagaaagttcacgttgcctagaacagaaccttgttgttaccttaaagtgtgttctttctgaattttctaattcaatcatcatctcttccaatgcacatctccaaacctcccatttcacttgttcaattcccccattagtagtgatatttatgctcctcaggatctctgtgtagcaaagtcctttagcgaaggcacaagaactagactatagaaacattcaaattccatatttgccatttattttttgtataaaggtagatgtcttcatattaactgtaaaattagagtaataatggtagtttaaatttaagtaataatacctacttcataggagtgtcacaagaattgagtaaatatatgtaaaatatttagaaaagttgtttgcacatagtaggtgagcaacaaattatagctattattattattgacttctcttattttttcttatctatttacttcaagtttttactgttcaaattctatttttcatcacttcaaataactctttataaagagcccccttgcagttcttccatcatgcctttcttagaatatcctaagtctagatgaaaatatccatgtccacggtgaaaacctatgcagaaaactagcctcatggtctaacctctgtcacagatcgagctctcaacactgcacagcaatggaacttaacttctttggtcaaactcccactctcccattccccagaataactcattaaaactttcctctttctcttccaatttccaagccagtcctattccattccttcttcctcaccagataacctttctttctacttctgtgacaaaacaaagttttcaagtggcactcccaaatagtgctgccaccatctctgtggacctatttgtaactgccactgtctttttttctgtctgttatcatgatgctgtttctgaccctcctcccagtaaacaggaatccccacaagtgtaactagattccatctccttccaccttctgtagagtcaaatgcttttaactttcatctcttctgttgtttcttggagcctccttaataccatttaattatttttgattgttccaatctgataacatttctccctgagtcttacatctccttcctcctctgcacagccaaaaagtaggaaaaagtttgtcatctatagtgacaatctccatttcctttctttgcattcatccatccattcattctacaacctattccaattgttatggactgaatgtctgtgcctaccaaaattcacatgttgaagccctaatcccagtgggaagcctttggtgggtaatgaggtcatgatggtggagccaacatgaataggattagtgtccttctaaaaagaggacagaaagctagttaatctcgttccaccatatgaggacacagcaagaagacaatactctgaaagtcagaaagagggccttcaccaagaacctctactggctccttgatctgaaactcctaacctttagaactgtgagaagcaaatgttcgttgtttaagcgatccattgatggcattttgctatagcagccaaaactgaccaaaacaccaatttagcttctgttcctactcctcaaatggatacagcttatgtcactaattatggccctgccacgagcttatattttactgagagagatgcattaaagatttttaaaatgtaagatatatagtatattagatagttgtaagttctcagaagaaaaataaattagaaaaatggataagaagtgttaatgctataagttgaattccaattttatatggtagccaaaaaaggcgaacctgagaaggtaacatttgaggaaagaactgaaggatgagaggaagtatctgggggcatgcaaatatctgagggcagagggatcagcaaatggaaaggcccattatttttctctctcgtgtttcttttttcctgtattctgtgaaactgttttatggtttgcctcctctcccttattgaaatttcaaccatgtgcagtaactattcactgcttagcatgtttttttccaatttctgtagttcttgtctcaattgtttaatttaaaatgtgataaagattatttattttattatttgactagtagtgtctaattttcatacaaacttaacatatctccttttaatattttagaagtaggatataaaatataaataagaaattaaaattaaaattcatcagtatatcaattgagcttttactttgtaaagggcactatgtctaacagaaaaaatgatgcaaagaagccagattgtagtgggttgaggtatgactgggaggtaaagacgtagagtcacgctgttcagactacatattcaaaaagcttggcagtgaaatgccttccagataaatttgtagttggatacagcacaattctgacagttggctctagcaaattctttcaggtttttaaaactatttaattatgaacatatgaacataagccttaattaagacaaatctttcttctgcctgaataagaactgccaaaatgtcagagggcaagactaaaagttcctgtctgaactcattttacagtctccacatttgcagactgtataatgctccatactaccagcaatcactcagcacattctcacactgttttagggtcacctcttctgcagtaggaactttggacttacacaataagaaatatataaggaaccacagagtcagaagcagcttgtactactcaaagcacaattttccttttggggcctcagatctatccctcagatatttattttaccaagactcccaactatatcttttcaagattcactgtcaagagacacctgacttttgagatcttatcctcccttagtatagaagtcccagttctcccacttatccttcttgccttggttgaactttctaaaacctagatctcttgccattaaaagtgtcaaatttccacaaatccacaaaatcaatcctttttctcctatgctatagtccaagatgttgtcctgaagtaatttcagactatttttcaaaagttctattggatcctatgtcaatttttttgtgatgtttgctgttcgtttaattcacaacatcttttcctcaaactaaactgaactggcaagaaacagataccagcaaaaaactgatacaggcaaagtttaaatgattcaaagtttacttcttacatgccttcaacataaaagtttattaatctttcaaaatgaacatattctctcaaactgaaggtatgaaattattacaatgaaaagaaactaaatatattaaatactgtataattatctcatttatatggctaaggttattagcttatatatggtgtctttaaaataattcccatttgcagttacatttcaaactgccgatttgacgcaccagtcaggaggaatgccacgactcctgctgtgctaaacttactgaaacaaataggaaaaacactttattgtgttttgttcctgttttactattttgtaattggactaccctacaggaaatactcttctttataatatatcactaagttactataataatcttgtttcatgctcttcctttacatatattcctgaattatcatttgtcatgggtaaaaatagtatgacagaaaaaaattgagacattaatcaaaaaggtgttttaaaattactgataatggtgattgctcttaattacatgattgaatgtatattcagagaatgaaaatatggacacacatacttctatccaagtatctatgaaatgggactacacaaaaaacagagagatgagaaatattttgaaaaatgtgacttctccaattttttaagaaaaagattaacagcatatatttcattattaaaagactacaaagttccccttctgattattaaatgaaatatggctgaaaagttaaaatttccttgtatataaagcagtcttgaaattcactcctgtaaactatgacttagggttatatttcattatgcttatatattaccatgcgttacatggttagttttaccaaagcaaataacttttatgaaaagtgctgatatctttattgatgaatttaaagtgttaattcagaaaatacttggcaactccacctcatatgtacctggacttaaaatatcaagaccatttttaaagtgaaaataactttgaaaatattttgtcactgaagcagtgcaattcatttaaatggttttaaatcgaagtagttttatgaacaattgtgctaaatagcaatgaaatttcatttctagtgaataatgaaaagtctcatcacagtctattaaaaaaacaaaatttgttgttatattaaacgttatttttcttgacccttattctcatttgttatgaatatctctgagggaaaaacaagagcctatgtagtgggatataatattcaatttagaaatttatataaataatgcctgttctttatgtattatcaccacttactaaggatcaaactacaagaatactaaaagattttactttacataaagacacatatagaattttctcagaaatagacacgcttgtgagtagtgaaacaattgaaaggaattaaacataatcatgcaaattacttcccataatataaagtcctaaaactatttgtgaagtctcaagatgttaagatgctatacaatttcattaagaaaaataaatgaaaacatttatttcataaaacattaattagacaaattctacagtgtattttgagtttatctatccctacagtatgtcattgatatttatcttcctacaccaaagtcaaagtcatttgattgtgttcacccaagtatagcatactcaatgatacagaactctctccagagaaaagagggaattaaagaaattagaagataacaggttgcatattctagctgtaaaaacagacacttcaggataggtaagtgtttaagtggtcacataaaaagctcaattaaaactaatttaacttcatctcttaggatttgtaaacctattcttttgagcattgaactgagttgacaggacaaagttatccttaattattatttaactagaccaattaataactaattcttaccaaagtaataaattatttcatttacatatgaggtagctgcaattctattatggttttataaaaaagataaatactaattttgcacttgataaaatattttgttaaaacaagcaatctagctacattttgattcgtttaaatgaaatataaattgaaaagtaaggatcacagagattcagaggcttactaaaaattacagtcagtcccactgacagagccagatgcagaaccctgggaatgtaggagaccaactaaaaggcaaagcaaatgaatttggggattgaaatgttgagtctgaagtttttgaagaacaatcaaatgtcaaacaaacatttaaaactgtaagtttgagattcaagagggtgactagggcagagaacacagacttgagagacactgatacacacagtggataagagccaaagaatagaacatgaacatagagtgagaacaggaccaggcacgaaactttcttacgtgtccagattttaaagaaaatataggggaaaaaagacagtgggttaaatattttgcttgaaataaacaaaacagaaagtaaattattttaaaaagcacagttttgtcttcctttaaacataatgatatgtagttgcttatattcaatcaatccatgactttgattaccaaaacaatgtgctgaggtagacacagaaaggaatttcaccttctaggcataatgtagtaagtcacaggaggccagtgaatgttctctctgctaaaatctagaaaaagctggataaaccacaacaccatattttttagaggcataagagatctgagaaagcaaggagaagtagacaaacaaaagttcctaagagaggagaactttcttaaaatgggctaaggagaaatcagcaaaacgtttaatgatcaccggcacaggcggaggggtgttataattggaaaattaagagaacaaacacatctgtttccccactggacacatactgaattcaagaggtttgtgggaggctaaaaaagagaggctagaagcttccaaaatacagaaataaacaaaatgaatgagggttcaggagaagcataaaatgtaaactgtcagacctgaaagaaaaaaactgaccaaattcaaatcatagttggagattttagcaaccctctatcagaatcataaataaatgacagtaatgatactgaagagctagataaatctacctattgcctcaatctaactgatatttatagaacactaaatccaacaattgcagaataaacatttttgtcaagttcacacaaaacattcaccaagaatagaccacatgcagggacaaaaatcaagtttcaaaatataatcttacacattttattttcttgccataatggaagaaaattagaagtcaataacagtaaaatctagaagaaaatgcagttgtttcacatcttcaccaaaatttgggttttgccagtgttcttaatattcatcatacaagtgggtataaaatagtatgttactgtcgttttaatttgtgttttcctgatgactaatgatgttgagcacactctcaggtttctactggatgtgtgtatatcatcttttgggacattttttactcaaatattttgactatttttaaaaattgtacatacttccttttttagaatattttaggttcacagcaaaattcaaaggaatgcagagttcccatatttctgctacccccacacaagcaaaaactccctcaccatcaacattctgaatcagagtactacacttattacaatgatgaactaacattgacacatcattatcacacaaagttcatagtttacattagaaatcaattttagtgttgtatatcctaaggcctttgacaaatgtataataatatggatctatcatgatagtatcatacgaagtattctcactctcctaaaaatcctctgtgcctcacctattcatctcttcatcttaaacccctggcaacccctcatattttcactgtcttttagttttgccttttccaggatgtcatacatttggaataatacagtgtgtaatcatttcagattgatttctttcatttagtaataagcatttaactgtactccatgtcttctctgacctgatagctcatttatttttaactctaaataatattcctttgtctggatgtaccacaatttatttaggctttcatcttctaaagaacatattggttagttcaaagtctaacaattatgaataaaactgcagtaaacatccgtgtgcaggtttttgtgtggacataagttttcaattactttgggtaaatgccaaaaatgcaattgctggactggatagtaagagtatgtttaattgtgtaagaaagtgccaaactgccttccaaagtggctttactaattttgcattcccagcaaaaatgaatgacagtcccttttgctccacattctcatcaacatttggttgtgtcagtgttctggattttggccatcctaattgtgtagtggtatctgttgttttaatttgcaattccctaatgacatattttcacatggttatttgccatctgtatatctttcttgatgaggtgtatgttcagatctcttgcccattttaaaatcaggttattttcttattgttggattttagtgcttctttttatatttttatgtcatttatttatctgttatgtttctttcataaaatttttaaccagtctgtagcttatcttttcatttccttgacagtgtcttttgcagagcagaagtatttaattgtaataaagtctaacttatcaattgtttatttcatggatcatgcctttggatttgtatctaaaatgttatcaccaaatccaataacatctatattttctatgttatcttctcagaatatagtaggcatgtgttttctatttagttctacacttcattttgagttaatgtttgtgaaaggtgttagatctgtgtccagtgtgtctagatttttttttagcatgtgtatgtccagtggttccagtatcatttatcgattgaaatgcctttgcacctttgtcaaagacaagttgattatgtaggcctatttctgggctctgtattccagctcattgatcgtgtctatcctttcaataacaccacattgccttgactactgcagctttacagtaagtcttaaatttgggtactgtcaattctcagactttgttctccttcaatatatgttagttattctgagtcttctgcttttctatataaggtttggaatcattttgtccataagcaagatataacctcctgatattttgattgtaattacactgaatctgtggaacaatttggaaagaaccaacatcttgagaattgtgagtattcctgtccagaaacacaaaagatgtttccatttattttgtttctcttcaatttctttcaccatatttttatagatttcctcatatagattttgtacctatgttatgagatttattaaatatttccttttttggtgctaatttaaatgatattatcttttaaatttcaaattcttattgtgcattgctgacatatatgaaaacaattaacttttgtatattaatcttgtatctggcaaccttgcctattagtaaggaactaataattgttgattagttctaggaaattttttggtcaatttttaggatttcctacatggacaatcatgtcatctgtggacaaatgtagtttcatttatttcttcccaaactgtacacctttattttcttttctttctcatcacattagctagtgctgccagtatgatgccaaaaagcactggtcagaacgaacatccttgccttgttcccaatcttaccaggtcttaaattggggtttatatctttttattatttaaaatatttatttatatatccataatctttaaaaaatataataaatatatggagtaattttattttgtaaaaacactgccaaactgtcttccaaagaggccataaactttaagtgactctttcactgcatttgaaaagttttcatgtttaatttcattgttcagttcaaaatatttttttaatttcccattatttattttctgacctatggttattttgaagtgttaatttctcaatgtttagaccagtatggctaaatatgagagataaattgagttctaaaatataaagtcatggaggcagtagaggggatcaggatcacatagggcattgtcagaattttgactttaagtgcagtttgaaatcactagtgggttttgaacagaagagaaatatgatttgaccaaattaaaagatcactcaagctcctgtgtgaagaacagtctttatggataccagttacaagagtaatcttcaaccatgactgcattctgaaattatctgcaatgggatgcttcaaaaacactgatgctaactgctacctctccaacacatacacatacacacacagacacgtgattcatgcatgcctgtgattctcatttaattgatctgaagtttgtattgggattctgttaaccaccctcaccacacctccagcccaagatgtcagctgttacaatagccagcaattacggtggcttggactgaagtggtagtcttagaggctgtcagtcttttaatattttggatatatttttaaaggagagtcaacaatagtttccgattgactgagtgtagaatacgagggatggtttaaaaaagactagaagagtcaaggactacctaaaatttgggagtaagctaacttctgttgaactacaagacaaatcagtggtcacagggagatgcaggatagctgaggtaccatgtagtatacacaatatcacagaattaagtgtctgaggtaactgtgagagtaggtgactgggttaaggtggagaaccaaaaatactggagaagaattgaaggaatagaggccagctactgaacgcctcatctatgtaggttattgaattaacaaagaatcaggacaaaagttggacaaagcgagcccagagacaaactttataaagaatgaggagtgtgaccaaaggatccataggtgtctacaggaaggatgggtaacaggcaatatgatataatgggaatcacattttatagatttccagaagagaaaggtaaaataaacaagcaccggccgggcgtggtggctcatgcctgtaatcacagcactttgggaggccgacgcgggtggatcacgaggtcaggagatcaagaccatcctggctaacatggtgaaaccccgtctctactaaaaatacaaaaaaattagccgggtgtggtggcgggcgcctgtagtcccagctacttgggaggctgaggcaggagaatggtgtgaacccaggaggcagagcttgcagtgagccgagatcatgccactgcactccagcctgggcaacagagtgagactccatctcaaaaaaaaaaaaaaaaaaaagaagcatcaacgggaaataaaaagggcacttacccatctcgcttaatacaacagatgtgaagagaaaacagcatcatgtgttaaataattatatagcatatcatcctattttccctttaattacacattaaagggagtgaatatttaaatttgatattgtcaaataaacctgcaaagaaacattctactaatgtacactctcaccaatacagttccctatccatccagttacaccagagacctgactgttaattctcttctcccatccttcacattttacatcctaaacatctctccaatccctgcacattacttgagctctaatatccatattagagctctcatatccatctcttaccaaaaccagtatgacaggctcccatgcagactctctgtattcattttagatccttctgaacctttttatttcagccagagtgatatttttaaaaattctacaattatggtgatatatctcaaaagcttaattattttacatacttacctagtatacgaaatactcctagtatagagagtatttagtaatacgaaatactcctagtataaagacaaaatttctcaatggggtttcccaaggttggcccctacctatagcttcaacctcatctcccacaatgtaactccgtaccctctgcgtttttcatattggtcttcagttactttcatctaccccatgcccacaaatactttacatcagaaaactctcatttatacactggcctattttcttagcctatatccacttacccttctttcagacttcagcttgattaactctttgttgaagactcccctgtcaaatcttcctataatttgttgaagactcccctgtcaaatcttcctataatttacactcttagcaacacttcttcctctttgtagaattatcttagttacaattttatatacatttgtgtggttatttgatcagtgccacctgcctgcccgttatccaattttcatgaggataaagctcatgaaaatttgctcataactgtatctccagtttctacttgtactttgtatatgtaagaactcaataaatatttgaaagactaaaccaggtgtaagagtatctccacaaatgttcaatgccactgtgccttcaatggccttacactataattcttaaactagagtcatcccttagatataaatgctagtagtattcacaaatacaaacattgctcaaaacaataaatatttcaatgtaataacccctctttcttaaagaaaacctctaaaatgtcatagattagatctcagccccttgcacataaaaaataactttgtttcgaaacttcagttttacaatcaatcagtattcttaattccatcttaatacacatactaaaatttaaaactatattaaaatacataatcatgttgcaaacatacataacttttcccctattataatctccaaattgtaggctgaaattcaaagtgtatatgatagtgcactgtaactcttagctataaatagttcttataaagcctaataccctttaattatcaatcacagataaagagtctgaggtcattaaataaattaatttaaaactataaaaaagtgatacatacacatttgaaggtatcattaagattagaaaatcactataagtggaaattttagaaaacaatacaacagtcatctctttctggtgataacttctttctttcctcatcagttattatatagctgtgactattttcagattttcctttacccactgcttcttccccactggttttgctttaatcttccctcatgattttagaattaataaatgcatgctgatgacttaaaacattttatgcacatcactggcttccatctaaatactttcaaaaaaccacctcttttgacagtaaatctacccctaggcactaagctttgaaagcaggaattgagggctgttcattcttataccttagcacccagccttgtgcctggtatttgacaggcctcataaattaactgaatttaatgatcaagaacagaaaaagatttgcctcatattgtttttagtaactacaatcactttctgtataattagagataaacctgaaatgtgataagccattcaaaaatattcaatctgaatcatggtgcaaggaatgtgtgtgtataatatttatgtatgtcttcaaacactaaggacttttttccaaagtacatttttaagactgagtaccctaacagtaacacaataatctagatttagtcaagtcaaatttatctactatgctatatatttatgaggatacaaaatataaaacttggcttatggagaggtattcatggtcctaaattatttggcattttaaaaaatactctatttctgggcatcatcatatttaaaatgtatttgtttttataaacaagcagaaaaatcataatcacaggcatacaatgattcaggtatgtctagaaattattagtttgctcatattaattataggtttcaaagagtatacgttagtattgatatagtcaagaaacccttctgcaataactatgtcatctatggaaatatgtgtgacaaaaatatttatcatgctctttaaaaacagacaggtactttggtggaagtactgaaagaacaatcaattctcaaaaaatttcagatgaacagattataatcccgagtaaatatgaaatgcaggacaagtcttgtattaatgccaaagaacaatagactttcattttggtggaatgccccatacaaggaacaactttcagactgcagttaatggtagtgactggctcgaactggctacccaatgtatttaaattatttaatatagcttcctcatatgcaatcatctacctttaattatgtgtcaaaactagtaattattttcattcacaggaagaaaattcttatcattttttcactactaaaaagaaaaaaaatctgattccccaaacagctttttcatccaagctgtttaaatttcaacccaattcttacctctgggtgagaaatgtctcaagcaatattccctcccagaatatgaaattataaacatcatctaagaggatgaagaaatgaaatatgaagaaaaaatatgacaatgacaaatataatgccagtaagtaatttaaccttattgtaaatcatttttctttccccatctaaaagaaaaaaaagaattactctaaactctcctgaaagatagagaaagatgctagcaagataattggtttgtaaacatagcacagatatcaactaagagtattacctctgtggtccaatgacaaacacccatttccactaaaaattgatgttatggaagatctctaaataaaattactactattacttctattccccagccaaaataatgtcccttaaagtgggacagagctataagcctgaagttagaaaacatactaaattaaactaaatttcctagaccccttgggaaacattaggaagactgatctttaaatatctgtatataatttcatgatatctattattttattcctgtattcctttaatgaagctttctctaatatgtgcataaagtgtactgacaaagtacttttatcccatggcctagataggaaacacacagacacacacacacacacacacacacacacacacacacacacccctaaaattttctgagaggtaatgagttctgcaagaggaatgagtctgggttcaaattctggctccttcaattttgtgccatatgcccaaattactttacctctttcattcaatttttattcacctaacctttattgatctcttttggaaaagatgacactgaagctgagagctgaatagcaagaagcagcaaggcatggaagagcccatgtaagaaggagcccaggtaagcatcaggtccaagcctggaaagttttagggatggaaagacggttggtcagaagctttgtgagcaaggctgaaagaggttagacatatggttaatgagtcagaggaagatcacaaaggtttttgcaagacaagttaggagtaaggaatttgtcatttattctaagtaaaatagcaagcctttggagagaaaggtcacaatttggttcatcctggtgatctgtggaaaatggatttttaaggaaagaatgtaaaaagggaaattagtagttcagatgagaggtaaggagggtagcaggggagaaacaaaactggacagattccaaggatatagctttaacaggaatttttatacaactttcttactgattagatgcgcatgtgagagagaaaattttttccacgaattccagatttgtagttcaaataactaaagatgatgctactgccatttactcagatagaaagacttgtggatgaattggttcagtggagggttgtggtgagaaatccaggaatctccagcctggccaacatggtgaaaccccgtatccactaaaaatacaaaaactatccaggtgtggtggtacatgcctgtagtcccagctactcagtaggctgaggcatgagaattgcttgaatctgggatggggaggatgcagtgagctgagatcgtgccactgcactacagcctacgcgacagagtgagaccctgtctcaaaaaaaaaaaaaaaaaagaaagagagaggaaagaaagaaagaaagaaagaaaggagagaaagaaagaaagacaaagagagaaaggaaaggaaaagggaaagggaaaaggaaaaggaaaggaggaaggaaggaaggagagagagagaaagagggagaaagaaagaaagaaaagagaagaaagaaaagagaagagaagagaaaagagaagagaagagaaaagaaaagaagtccagatccagatatcacctttggatatgttaaatttgggttgttatttacatactgaagtggctaagtcaagtgtctcattgaagtgtaaagctgaagtttttttaggggagacatcaaaagtagagatgaaagtatggcagttatcatcaaatagatggttatctaaggaaagaaatgataactacctaggaacagaggagaaaatagtagaaacaaggcattccaattttatgtcctataatatgtcaatatttagacattgaaaagaggaggacatagctgccaaggagagttaaaaggagtggccaatgaagcaggggaagaataaaatgatgtaaagtaacttaagcctaggaggaaaaatgtttcaagaaaggatagtcaattgaagcaaatgctgcagaccagtcaagtacaaattacagatttggcaacacagagcactctcactgaacagacagcaagagatgtccaggtggagtggattaaggtgagaccaggagattagaaaatgaaaaacctttattgacaactctttcattaggctttgagggtgaggagcaaaatggagtggcacctggagaggaaaatgtagacaggtttcatttatttgtttgtctttaagatgcacaatatgcaagtatgaagatgtaaataaccatgtaaaagcaaaaattaacgtttcaggagagagagagtaattacacaagggaaacttttgaaaagactagaggaaatgggatccagatcacaagtgaaggtgttggcctttgacaggagcaaggcctttccagccaccatatgaagccattgaaattagggtttattcccagttcactgcatatctgcacatatcacaacagctgtcaccaaataacatcttgcacatcaataaaacaccaagaacatttacatttttaatttttaatttttttttttttaggagatggattctcactacattgcctaggctagagtgcaatggctattcacaggtgtggacactgtacactatagcctcatactccttgtgactcaagtggtactcacaccttagcctcctgagtagctgggactacaggtgccaaacacattttttaaatggagcttagaatatcctatataccatctcctttcactcaaaaaaagagaaaaaaaaaagaaaatacaaaaacaaaaaaccctctttgtagactacaagaaaagtattcaagattcactaatttattaaatatgcattgactaaatttttaataaaagtaattctttagataattccatgggtataaaacttacaaaggcattaaaataatagaccacaatcaatattttttcaatcggtagcagatatcatagatatgccttagtatagataccatgattcatctacttaaaagaatcataaataaactaacacaatgttgtccttttataagtaccatactatacaaagctaattgtccaactaagagcaacattatactgtttcataatgtaaatgattcattggtggttattccacattttaactataaaacataaacatgaataatcaatgctagttaattcagtggcactagtacctatgtctcatgtttgttgcatattggtgatttcacaagctagattgtctgtttaattcctaatcacactaattacttgaaagagtaatccaggaaatgtgacttattcaatttcaaagaacagcctagaaattagtagatagggcacctcagtaatgttatatagtcatgttcattgataaaattggaaggacttcatagtatttgtattaatctatcagagaaaatcacaaattcttaatatatttctccaaacattatttgaaatttcttctaatggacttaagtcatgtttgctctcaaccaggggtctgcaaactacaacacaagggctaaatccagatggctgcctgtctttataaataaaattttattggaacacagccacatcaacacagccacacctatgcattcacatatggtctacagatgcctttgtacaacatcagcacaattgaatagttgtgacagaaattatgtagcccagaaagctaaaaatacatgctatctggccttttacaataaaatgtttccttacttctactcgattttcaaaagaggcaacacattttttaaaaacaacttgtcagaatgggagacttttttccccaaaataaaataaacacaaataccttcaatggaaggtatttagtacacatcataataacctgtagaaatgctggataagaaattgtattaattatcttctaaatggaacaagctgatatatgagaaatgagaaatattataactaaatgtcaatgtctatcttccagaagagatgacttacaaaaaaacatagggccagctattttattatagtatattgtgacatatataccaaataattagaacgagtaataaaaaatgccaacgtgcttataaacaatattatctgtaaatctattctattagtcttctttagttgtagaaaatgacaaatataattacaaaatacttattcaaaacatgtaaaccactaattttccacttgtaaaagcctgattcaaaaagcaatttactttaaggtttacttaagctttgcaactacattaaaatatgatagtatatacacaacagcttgttaacaagattatcataacattaaaatcataatgtggcacttcaattatggatacttaaaattaaagctaatcctcacagtaccaatttttatctcctaaataattttagctattagctgctcattcaaagtctgtatctaaaatgataagcattctagagtaacgacttagctctgcacttttctttggtagcaaaacaaaagctgcatcccttctttcctagtccttaatatacaatcttttgatactaaggggaaaatgcagttttttcctgaccttgcttggctcagagcttcttactcatgttgctgttgccaatgctgttgtttcaaacagatacattctgtatatcaatggtacatatttcttttctggttttatctttccaaaaatatcaaactatcacttgcaatattaatttgatattttctgcaaatactatgtttgaacaaatgtcacctagtacctactaggcaccaggtggaacaaaccaatgcttagattaatgagtattataatgtatttcataaataaataattaataacaattaattgtgttagcctattaactgatttcattttttctactgtttcaccagatttgtacttgataattatgtaatcaatatttctcacctttgaattctaattcaagtttaaagtgaaggaaaagattctaaattgaaagaattctgtatttataaatgacagttaataacaaatccataaataatccagaagcattgttgccgaccatatggttgattttactaaacactggtaacagctaatataattgttttcttctatttccccaattaaattatatttgggccatttgagcagtgagattggaaactgagtgtcaaatcttgctttcactcactcctaaagtgaatgaatggaagtaatattcctaatttacatggcaaacagataataccaaatgtgtgtatccgtgtgtgtgcatgtgtatatatgtgtataaagacatatacacacattcatattacaaaatgtacatgaaactaattatataaattaccaaatgtgtgtatccatgtgtgtgcctgtgtatataggtgtataaagacatatacatacattcatattactcaaggtacacgaaattaatcacatacattacaaaaattacataagactaattacatatattttctgacctgtatttcaatgatatttattagggcaggtgcatgattatgtaaagtaatcatgcacttttgtcttttgatttcaaaaaaatctgaaagtactcatcctgattgacttcctcatgtgttaggtggcataaaccaaatcaaagaacctgctctggacatggtgaaatatgtgtttttctgtaatagaaatgataaagataacatgttctctgtgcatagaagacaagagaatactcttctctgctgatttggggagtagggctttcaggaggttcctgctgatctatttagtgatagaaaacttggaaaaacataattaagatagaattttagaaatgattaaaatagaaaagagttgaaacattgcttctgaatccaatctcactgctcaaacttttcaagtagttaaaatatacccttatacatgggcatttctgattataaaggaatttgtttttcaacactttgaaaattaaaaaaaagttacaaacgttaaatcatgtattactacttccatcattacataacattttcagaatgtttaaaaaattatttactttccatactattaaacaacctgctaatttcactggaagtattttgttaatactttctcattttatttattttatattcttcttcaatgccactttgatttttccctcatagctttatatttactttgtaaactacttaatcaatttgctaatctcaaatacttagcatgccttgtccttccactcttccatttttaactattttaaaagaattccataaaatttccttaaatctttgtaatcctaatgaatacacctgaaaggcaagggaagtccaaactccaaatgctgtcacagtgcaagttttccttgactgcaaagaggagattttatagagaaatatatccatacatatacacacatgtaatatctatataatacataccacatatagaaatatgcatacacatgcacacacacaaatctctaagaataagataaagtagaataatggccatattattatctttaaatcttattcagaggaacaaaattactcggttcatggtttactaatcacagcttcctcggagtcatggttcatgtagaagtatcagttaaagtatcagtgtaattcaaccattatatttagcaacagatgcaatattaacataacccaaatcataaacagctaaaataatacctaggttccagtagtaacacaacccttaggtcagatggtagtcaacaccagtactactgaatactaacagaggagtgaaattaaagacatacattaggctaatacacacagacgggacatacctgaaaagctgaaaaactacctcttttaaatgtcttggtatctcttttcggacctcagcctttcaataaaaagttagattgctatttatattgcttccacctctaaaagtccttgagttgaaggtaaagaaacaatgacattaaagcaattttaaccttttgactcaaataatatttagaaatgttagacctcttaaaagctactttccaagtttacatggctatacttttatatttaactctgtataaatggctgtttatgatgcacctacaaatagtatacacacaccagtaaaaaagccagcacagataaactgtgcaactcaacatcaccatctagtgacaaaattcttaacacgtgataaagccaagcgaaaaagaatacatttcagagacattctgtactggtagttcatctttatagtactaatgtaaatataacagatctcactgaatagacttcgctctgcaaataaaacaatgcctaatggcaatgttggcactccaaaaataatttgtattcttgccatagagatatactcataaatctattaacaatctatattttatgtgtattaagaaatacactgtaaaaaactcccaatagtatttttattttttttattaatgagtatattctatatgtacctcttctttttcagaatctgacgtcaccttttctcaagttattcaattcaagtaccttccaattgcatatatctattacccatagccctctactgcctgtgagactgaaaagggacaaaaagacaacacattggaggccgaggagggcagatcacctgaggtcaggagttcgagagcagccttaccaacatggtgaagccccatctctaataaaaatacacaaattagccaggcatggtggcacatgcctgtaatcccagctacttgggaggctgaggcaggagaatctcttcaacctgggaggcggaagttgcagtgagccgagaccgcaacaatgcactccagcctggacaacaagactgaaactccacctcaaaaaaaaaaaaaaaaaaatacaacacaatgttaaaagtggccccatccttccctttactgttcaggatttatcacaggggctaaaataggtacagaatatgatagtaaagaaatcaaatccctttggcatgattacagagttgaatcaaccaagataaagaaagaatatgatgaaaagaagttgagaattttacctctaaattcattatcatactataaaccagagatttgacctagagatgatgcacttttttcctgtccttaaaatgctttttctttgattatcattttcagaaatgctgtataagatttccacacccatggcactacaatagactatgtagaagttggacaagatatacagcttctagtattctatatgctaagactgcagtgaacttctccattgaattccattatttatacattacacatgtaattcttgtaagcacatacaacattaaaaggaaaaatgtatacaaacattatattttatatcttatttttattaattttcataaattacaaagcattctctcctctatatcctagttcctcatataaatcctaggagattttaaatcccattttacaaaaaagtaagagtaaaataattaatttacctaaaattacagttggagtctcaaatctgattcttactattgattccagtatttatttcatatttttagttttctccatttttccttcactgtttttctaattattcataatatattcccattacagaaaatatagaatggaaaagcatacgcctcaaaaaattatctttacgccaaccagccagatgtaatagccacatttcattcctattttttctctgcattttttatattcagttgagataatattctacaagcaattttgtttctctctctctctctatatatatatacacacacacagatttattttaaatatatgtaaatctgtgtatatatctgtaaatataaatatattatatatctgtatatatacacagattttatatactttataaatttataaatattgtaaaattctaaatatgaatatataaataatatatatttatatgtaatatatacatttatatatatttatgttatatacatataattgccttgtctattgtcttaatggtagacaattagttcctgtaaaatttgttcagggttatattccataatttgagtatcacattcatattatgcataatttctatggcttctgcataatatattcctagaaggtaaattaatacaaaaaaaagtatgtttgttttaagtctcttaatacttagtgacacaatcctttccttaaatgcagcagtaattttcaatcctctgagaatgtgagaatggctgtctcaccattccatctctagccatctgtgagaatggctgtctcgctattccatctctagcactcaaaaacttcccaccaaactgcattagcagcaataagcaagagattggtgtattttttgtgaaatttacactttttgtttgccattagagttgaatatttccaagggttacttaatcatagtttgccaattatctactgagttcccaatttttaaaatctgtcatacatatggcaatatagtacattgatgtcttttaattttgtgattgtccccatttgcataagttttttaaaataagtttgtttttaattggcacataatagttgcacatatttattggatacagtgtgatgtttcaatacatattagattgtgtaatgatcaaatcaaggtaattagcatatctattacctcaaacacttgtctttttttgtttgtttgttttgttttttgttttttgttttttttgagacggagtctcactctgtcacccaggctgaagggcagtggcgtgatctctgctgacttcaagctccacctccccggttcatgccattctcctgcctcagcctccaaaatagctgggactacaggcccccgccaccatacccggctaattttttgcatatttagtagagacggggtttcaccgtgttagccaggatagtctccatctcctgtgacaacactccaaattttctcacgttattttaaagtatacaatatattactgttgactatagtcaccttactgtgctatagaacaccaacctctccccatttccactccacactactctcccaagcttctggtaaccactattctactctctacttctatgagatgaacgtctttaaattccacataaaagtgagatcatgcagtgtttgcccttctgtgattagcttatttcacttaacattaacattttctaggttgatccattttcttgcaaatgacggaagcttttttttttattattggaatcaaagcttagtgatttcttcacctacttgttagcgtatcatctcttcccccatctcaatctcaaaagtcacttctatattccactggactttgactgtttcatttatttcccttagctctttaaaaatgcatgaaatttcctttgggccatgtgaagtgagactacaaagtctttttttttttttttttttttttgtccaaacagcaaaaacaaacaagtaaacaaacaaacaaaaaaaaccttttataccatttactgggtgattgaacatgtcctgaactacttggggtacttcatcatataataacttcatcagatctttatagtatctattatcaattacagacactatttgttttaaataacacgcagaagaacttaagaatttccatcttcattttgaatacaatcacattaaaagatgtcaaattcttagggaggttttgttgttaattctgttgggctttctaggtataaattatgtctttataaaataagagctaccttgtctcctctatatcaaattatactttttagttttggttttacatctattaccaggttatggatctaccttttactattagttttctaagaaagtaagtgtatctatgtgtgatgtgtgtgaacatggtttagcttcactctggcctctccattgttgagaactctgttaagtgagaggcagtcaagtgtcatattagcaacacaaaaacttccctttagggcagcacagaacaaaccacagccactaaccacatataagtatttaaatttaaattaataaaaattaagtaaaattaaacattcggttcttcagttacactcatcgcatttcaggtactcagtggccatatgtggctgagggctctcacactaaatggcacagatggagaacatttctctcatcacagaaaggtctgggcagcattggtctagatgtctctaagagccacagaaaaacggccaggaattccattcccctgtccttttcttcttaggcacattatatttcagtctagtcttactctgttagagaaggttattcagaattttaaatcccaaaatatgttttttctggcacgtattttcctaagccctgtattttcgtagacatctggctggactctccttctttcttatcccaatgcactattcttggaaatcatatgccttcccttggctacaacaagtatcaaaatactaacaagtctcaaatgcgcacatcaactctcagtcttttccttgagttgttgcattgtattttccctctgcctattgcacatttacacgagttaacctcagctatctcacagtcacctgaaaacccaaatcttcactaatcctctttttttctctctctctacatcaattaatgtatttatttaacgttttatttagctagcatattccagagaaggttgtaacccctcgtcctttttacacaccagggctacaggctcagggcatcctcaagactgggatcaggaggaagcatgggagggatctaaagtgatttgtaaactcggatactgacaagaaaccagattcaagactgcacagcaaagactggccagaaagagagactggatgaggtggctaagaatcctctcttttctgttctaagctcatagaaatagtaaaacctaaataaataaggaggtacccaagatggtgaaaggccccccaacactgcagccacaataggacaatcttcagatgtgggtccaactctgttccagttactcctggctagacacactcaggacaagaacaccactgtggggacctggagccacttaggggctgctaaagagatcaagctaataagaaaaagggatgctccatgttctcacccacaggtgggaattgaacaatgagaacacttggacacaggaaggggaacatcacacaccagggcctgtcatggggtggggggagggggggagggatagcattaggagatatacctaatgtgaatgacgagttaatgggtgcagcacaccaacatggcgcatgtatacatatgtaactaacctgcacgttgtgcacatgtaccctagaacttaaagtataataaaaaaaaaagaaagaaagaaaaacggatggtcccatagccaagctatgccaggccaatggactaacagagaagctaccatgaaatattctgggccagggaaaagactgaaatactcagtctctgggtcttcacctcaagcatattccgaacacattttaaaaagcacctgacccaccatatactaaattgttgtatgctattaattactaaattattccactgtgtttaatgaatccagacattaccaataatgtgtgtctgtgtgtgtgtgtaagtaaaatgtataacttaagcaaacaagtacatttcatgccataaaattaaattctcacttaaattatccagactactgctttgtctcatagaatgggtggttggcaagttattccaggcaggtaatacttgtttttatcatcagttcatctctagttttttaaaaaacaggacatcctggtatgttctaaaatgttatgtataacgaaatttggcagaatttaatcatctcttcatttgaagttaattcttataattcaatttgtttttttcttgaggacaaatttcctacactgattacatatcctttccttgttccttgtattttcctcattcacatcatttttcattcacattgcctcttttcagttctttctgtcttttggtcttcagttcttttattcaaagcataagagttgccaccctctttgtcttcctgtttgtctatgtatttacttcaaaataaatagatataaaaatatagagaataactgcagttttccaagtaaatattggcatgcatgtttactgtatttaaacttatcataataagcatttacaaaaaatgttaaatttatagcagtggtaattttaggataaaccactatgtatggtgaaaattagaaattcattcataatttctgcattagctttttccaaaacaaatattttacaacttatttttaatttgctaaaattttcaataacttaaactttctgagaatatctgattgcattttatatagatacaaattctctattgtgtactcagttttatttttccctcttttttttattagtaaagacattaacaataaaataggctcacttgctccagctggtaatttctcatactagtaatatattattcctctttttgtgacatcataatcatctatacagaagtaccatgtatctttgtgtagaagctactgtttccattaaatttaattacctccccctgtggttttaaatagaagtggcttcaaaatgagggcagcttctattaaatttaattactttctcctgctgcttgcatggtaaaaggaaggttactaaatgagagcagcttctaaactaaagtatatggtaactgtgtgctagcaataacaaaattgtatctaaactacctttctaggaagctcttaggtttatcctttctctcattttaatctctttagccttaacatccttgaaaaatgagcattaagatagaagaaggcgtattttaaaaacatattttaattttataggctaaataaatataaatacactttctttacaaagatattggaaattatgctactcaaatattcaagctcagaacttttaagactactaacatttgttgttttctcactctgtggatgatgagttttatttcccacaaattttcaatgtctaataaaaagcctttcttgattctgatcaaatagatttgaaaaatgcttcactaaaagttatttaaaaggcatcaaatttggggcaatttcatataaatattcagaattactgatgttaagaaatgaaaaaagaaaaaaagtcaggctcattatagaccactatagttgaaaggaagttaattatatgctttgtaatagtgtaaaaatgtaaatcactaaaaatactataatataatataatcctataaaatgttatagaagatgaaaatgtaagtacctctctttaaattaaatattaattaggaggaaatactactcaattaaagcaccattgtacaatgtttatttctttatatacaggcagaatttagatgaacaatattttcattcaatcacacagtttagtataagtataaaacaagacaccccttaagcattttaagtaacaaattaaacatttacattttttactgtgcactgaggcttaacatttatgcagcttcaaaaccaaagtacagcctcaagggaagtctctccactgacaaattaataccttagagaacagagctgaatggtggcaatgaactcatttgttccccaaataatgaagaatgactttttctttaccacatctgtgactgttgctatggtgacccagacttacctcattgcttctcggagagctcctcgctcaccaagagtcgtgtgcttgatgtcatcaaaattattctccagcttctcacaattctgcaacatatttaaaaattgcattaattctctaagatcctgagaaaaattgtatctatgcagttatgcaaaaatgtaattgattatattgatcatggactcatgaaaaatatgcataccactttaattgggtagcattcattaaaattgacagttaaatccaacagtaacaaaataaaaacattttatgatacagctgtcacagaagtctcattatcaatttttcaaagtggagtttcgttatcaatttttcaaagtggataaacagaagaaatgaatttataaaagtaggaaaacttcttaagtttggaggaataaaaattagttctctaaaataatcttaagtatagaaaatccaatttaaactcaaaagagaaaaccattaagtttttgatcaccataaacagtatacaataaataccaagttctaaataagctagcattgactaagatgaagggatagagcacagatataataataaaagtttcaaaatttttgaatcaaaattttataatcagatctttaaataacaattttatgtgtaatatttacaactgcacatatatatttatatacttgaaactaaagttaaaatcttaaaattaggtgaaaattagattagatcaggttcttagaagaattttaagattgagtaaatatgacataagcagtttaaatttcataagtgtttctactttttggtaaaatagcaatactagactgaattttctaaaagtactttaaaaaatttttactacaattctaaatataattatacgtacttaaaactcacttaatctgagagaacccgaataggttttgagggcataaattgtagaaattttcaatttatatacatatatatatgaatcttttggcaccctagatttcttatggaatttactagtatttagttgataaaataactagatttagtgtattacttatttttacagaaagaaaaactaaatgacaaaattttagtattaatatgttctttctattcttgaataagtatcctgaattttacaaaattacagaaattatattaataatgtccaatgtataagaatgaattgatttgaaatatattggtatataaaccactatttttaaccttgatattttttaaaactaagtcaaattaaggcaaagatccttttaacaaacacacacagttatatgttgttataattaaaatctttgaaattaccaaaatgaatctacaataattaaaattatatatttttcaaaaagtccattttgggtatatacattaaaagtatcctcttctgtcttatcttcccacatttttagaagtgtctttcaataaagagaactgcttagctgagatcaaatttgttagttttctaatttaagtacagtgtttttgtgtgctgtttaagaaatttaaaaactttctcaaagttataaatgttgttgattgagaccattaagaaaaaatacacataattttttgtttgtttctttttggccctgaaattcctcatcagcttcctcctctttgccaatcctactgcaatcttttttttatttcttttttttttaattatactttaagttctagggtacaggaacgtgcagttttgttacataggtatatatgtgccatgttggcttgctgcacccgtcagctcgtcatttacattaggtatttctcctaatgccatccctccctcagccccccacccccagacaggctccagtgtgggatgttccccaccctgtgtccatgtgttctcattggtcaattctcacctatgagtgagaacatgctgtgttcggttttctctccttgtgatagtttgctgagaatgatggtttccagctttatccatgtcccttcaaaggacatgaattcatccttttttatggctgcaaagtattccatggtgtatatgggccacattttcttaatccagtttatcattgatggacatttgggctggttccaagtctttgccattgtgaatagtgcctcaataaacatatgtgtgtatcctactgcaatttttaactttacttgggcctccaccactgtagaggaacaagttcataaaagaattaaagaaataacaaaattattggacataaattttttaaggtccattcctagcataaacagcagggttggaagattacttgactatctagtttttctagccacagagacaggagataaacacattcttggattaaaataagagacagaagcctgggcagagtggctcatgcctgtaatcccagcactttgggaggccgaggtgggcggatcatgaggtcaagagatggagaccatcctggccaacatggtgaactctgtctctactaaaaatacaaaaattagctgggcatggtgggtgcacctgtagtcccagctactcaggaggctgaggcaggagaattccttgaacctgggaggtggaggctgcagtgagctgagttcgcgccacggcactccagccggggacagagtgagactccatctcaaaaaaaaaaaaaaagagagagagagaaagtggacacgtggacactgagagactgtagtagccacactgagtagccacactgagcgctcagtgatgccaggaattgaagacagccaaatttctgatttagctgaaataccgtgtttcagagtaccttcactataatgagtagaagcggcaaccttaataataattttatcaggaagtggttaaaatggcatattctgccttgatgtggaatgggaaacccaaaatgagtattaggctaactaacagaagaacaaatgctccatgttttacactttgtgtctgcatgaagtttattatacccaacagaacaacaaaggaaataagtaagcactgtagcatttaaacagttaactattaccttgactaaaaatacttctgtatacagaaattgaaatcaaatctattttttatgcttcaagaaccatatgtagaagcactaagtaacagacacatgatttgaattatatttcagacaatattaggctcttgccatatagaataagtatttcaagcaactaacatctttatctgctcaaacttctcataaataaaagtaagcattaaatatccactgagtaaagggcaaacagattcactgtcacgtttaccaccaataacacttctctaacattaaagacaactgcaggtaaaattgagccagcggcctccaatcaaaatctgttctcagcccactttatatgaacatggatctgagaaaaactgtaaattatttgtaatcaacaagttattcattcttggggattctgtaagttagtataggactgtcccagaatacgatttcagtggtaagtatcacataggggacttactttacaggataggaaagttcataaaaattcaaaaaaattatccatggtagtggcttgtgatttccaccctccaagtgcctcctaatttcctttgaccaatataatggcatgagaaacctacaaccatcacagcagaagaaaggaaaaggcaacagataaaaagagaaaaggggacagagagaatgaatgaacaaactactcctgagaacagcaagcagaagaacaaaaataatcagtgattagtaataaaatactggaacaaaacgcaggcctgctagcctagacaatgtggagcaagaaagtgggaatacacaggaaaaatggaaggtcacaaaggtactaaatttaatgccgaccagacatgccatgtaatataacaggcacaggttagctctaattaattggtagaaaactgaaaattcggaacaatttgtatcagcaaccatggtacacattatagctttaatatataatgtattgtgtgtgtgtgtgtgtgtgtgtgtgtgtgtgtgtgtgtgtgtattaattatagtaaaccagttaacattgagtagtgactctgggttaggtactttttctaggaagtctaaccatttaatctgcatgacaaccatatgtattcctattttacaaatgaggaaacaaccacaggggagattaagataaagcttgcccagggttatacagctagcaagggataaagcagggatttgaacccaagcagtctagcctcagagccagactcaaactcctcgcgagtccgcttctaaagagtaaactgcataagtgaatataataaagttctgaataggccttcctctaggtgtcatcaaatttaaatactgagctggatggaaaatagtttactagcagagtcaaatgtagcagaagctcttgcaggattctgtctacatctgtctggaagtgctatactttataatgtagaaaaatatggaatccaatatacacatttaggccaaattaatacccataaatattttgcatgcaacagtctttatttgggtctgtgacaccaccgtgacaaatataatgagcaattaaattcccaagtgttcagattttggcagcaattgaagtagaaactggaaactaagcatcaaaaagaactggttttggtggcctcctgccaaatgaatccccatgggttgagggaaggtctagagtttcaactgtgatagatttcatagtgttttatatctcatctgtgttaaggattctataaaagtataatgaaacaagtagaacaccaacagtcacatgaaagaaaataatatacaaggagatttcagaacgctgaggattttaaataaaattcactgagttatctttgctcaaattataccaaaaaaaatcacaaaattcaaccaaacacctactgattctggatggaggtggaaagaggcaaagaaaaaaaaaaaaaaaagaacagctagcaaattacattattaaataaaacaaatcactgataattccacaggactttatttccatgggactgaatttttatgttataattatgataactaaaactaaatcagatctaaaatttatatacaaacctaaattgaataaattaggaaaccaattttaacaaatgaaaagtcacaaagagttaatggcatagctactggagtttaagtctcagaattactaagtaacaaaggctcgagttaatgaattaaatttcagtgcagaaaaaaaaatcttgaaaatctattacatgtcaggaataatactatgcacagggatatgaaggtaaataagacaagacttcaacttgctcacatgtagtaagaatacagaggagagaaaggaaataattctcttggaacaagagatgactatgagtttgttacttccaaacctgtctttgaaatgatttacaattttccagattaagagaaaaaaagggggaaggctaaggtaataaaattggctctagcctcagaccttaccattactgtctacaggctaagtccttaggcaagttaattaactcagtttcctcatcgtgaaatatacttaccttctagagctatcaacaagattaaatgaggtaatatatgtaaatccattagtacattcagcaacgacgttttcaataaaggtggaaaaagaggaaagaataaacagaagaagagtatccatgaaccccaactcaatcctaatggatcagattttatatggtgaaatagaaaaaaatgtgcatttttcatgtttaaccaggtgatttttatgaataataaagtaaaagaaagtctttatggatttttttaaactttttggtcataagactcctatgagagtataatgaaaaccatgatccttttccttaaaaaattacattttcacaaaagtacatatgcacaagtacacaatatgctatgctatatacaatttcagtgggccaatacagctcctgaagcccatctatggcccaacgtctatgtgcaacaaattttagtatcagggaggatgatttcacaatggacctagacagcttagaaacggaagttacaaatataatcagtagtccaagaaccttgtgaaacaaggggtccaaaagttggcaaatttctattgctgtttgacaataaagcatcttaagttcaaacatcaaatttctaatttaaaaaaagacacaaaagtcaatcctgttgccaagctagaaatgaaaaccagtcattcattcattcattcaatatttatttagaacataatgggtgctagatagtatgctaatcattgagacaccaaggtttaaaaccttttttttaactccttattttgaaaaaaaaaagccaattcaatagggtaactgttataaggtaaataggcctcacatccattgccatgtattagtgatatatcagcaataattacaaatctcagctggttgaaaacctgcaggatactaaattttgaaggaacctcagagaattatcacaagggaaaccaccactcttatgaaggcaatgataaatttcatattttaaaatatgaggaatatttaaataaaatggcacactccaacatgtactgctacaattctaaggcagttcaatgttggttactacaaagcttttctttaggacataaagtaaattgggaaaaggtaatacaagtacatgcatttctcatgtagttagaatttcctaaggtctaggttcctctaaaaaaaaaaaaatgagtcaattaggtgaacttactctttctggaaaatgttgtatcttaatttttgcactcaacaagaagtctcaaaactagccctgctgaagttctttataagtacaagtaagaaataattactatattcatatttttttaattctagatgaacattctactgtcaatatatgatttccagttctaatcaagagattcatatttcaatagataattgcttttccctttggtgtgtcttaactagtctaatcctttcagggaacattaagaggtaatcatatttagctaatgtcatttcactaattgtggccagcttacaatcaggccctgtctaggagaatcttatatgagtcacagtgaaatacaatataatgcagtaggagaggtaggagctatgcagagagaaaatttgtttttgagtttcatctctacaactaaacagcttatgtgttcttacaaaaatgcttaacatctcaatctgcaaatagtccttcataaaatgaaggtatcaatgaagatgatgaaagtaatattatccactcaaagtgttattgtaaagattaaagtaaataaaaacatgtatgtgaaaatatatacattgttcaaacattattacatatttttaaaagatagaatgaatctcatttctgccttcatagtctgaaagtatgttaattttatttgaaatattttaagatttcatctctcatacacagtaagaattaagtaatattttagtacttttttgagataaattaaaagtttagctacagtatcctacctgctgataattcattcctatatctatgagaggtcaacaaagttcaggataaagtatttgctttttaatcataatttcatatttaaaattacaatgcgtttgtttgcataatgtatggttatattttgattgagtctcatatggtttacatgataatcaaatgaaacacagtatcattatttcaatatatattgtggagttctatgtcccatgtactgccaaccacaaactattatacaaatattgatatttactattttggaagccattataatttacttactcacttaatcttgacaagagggaaggctctccaagagcaatttaaaaatgaaaatctactatttcaaccagggaagcctgctcacctttaagctctgaacaatctgacccatctccactaaattaattaccaccacagggaaaccacagctacacaactgctctctaggatattatccctataaggataaaaaatttgatgtaatctagaggctttaaacttaaaacaatcccttgtccttgatggagtttttgctgaagcatctggcaatccctgctagactaagtggtgtctaagcaaatgaggaaaactttggtatcagggatggggtgcgggtggcaaagtcaaataaatccactgttactacttgaacatcagtggtgttcctctgtctcaattttggatggttaattttttcatctatgtttataggactatcactcacttaagaatgttaaatgtctcatttactcaatccagtgattttgttcatgcatttattagtaacacagaaaacacgttattcttagtctttggaaatcaagttttaatgtatgcttaatctagttaaaatatagaaaagtctatttagatggtatggctgtgtaatgcagtgcatgatgtactgtaataacaccacccagtgtgtgtaagattaaagttagacaccaggtaaactcacagatgtaaacagtcttttctctagaacatacttagaaggatcacttattttaaaaatacgttgtttaaaaaacaattaacatatgaatatgtattaccttaagctacctcaattctctgattggaaaaaaaaaccttgagatcacaatggagtgggtcagttcaaacagaaacaaggaatttactagattagggctctaaaaattaacaatctttggtgtatcatgaattttaaatgtacattacaaagaaaaatatgcaagccaatttaacataagtctcaataaatagtgcctaaattgataaactgatttttgtttacaaagaaaaaatatgcctaagatttccatatactgtacacagttatggaatggttggtactagatagatatcaaataaaaaacctaaaatagtattcatgatcatttatctttaaaagcacatgtgtgcattttaatacatgaggaaagattaatagaaccatttaagtttttgtgttaagttaaaattcagagaagcaatcatttttaagtcacaaaagataaagccttccaatatccttctggttttggaggaataaaggcttttacttgacagttacttacatgaatttgtatcaaaaagagaatttggcagagacttctaaattcataacaattgtctattagtctgtttttaataatttttctttggcatgtaatcctctttaattagattccactctctgttgtttcaagactccataaacgggtgtcttatgtaccagctgctaaagcaggagttactgtctaaatgatattcacaatgagtatttagaaggtttacaattatacccttgctaataaattgtgctattttccccaacaattttaagtgctaatcttcagaaggcattttaaaattagctaaaattctgtcaagagatttacaaaaattgttagcatgaagataattatgtcacagtccttggactccatctctgattgtgtgcataaatcagaaaatgtcagctgtgttttcccttaataattatccttgcagcaatatattatagtctaaactcctattataatttctgtttctggtttctaaaacaccagacagttatttcaaaagtttggaaccgaataaataattcatatttcccagaataataagtgattatcaattctaaaattgtaagtattagcaataaatagatcaatatggaaaagataaactctgttttcataaactctccatcctgaaaaaccaaatgcttgaatgtgataatgactttttaaaaatattaattaggtaaaaatctaacatagcagatagtaggcaaatagaagcagggatctgaatagaattctaaggcacccactattttttattccaacagcacagacacttgaaacacagatgtctgaaatacatatcaagttgcttatcatctgatactatccaattttctatatttcttattaagtatataaaattttgaccctcattttagaagatacaaaataaaaaagaattttttgactttcatccaaatatcaaaaattataagtatgcttttattttctctggttaaacagattagaccagaaatataatttttatgcaagctcagtaatcatgttaaaaacaagtctcagacagcagtctttataataaattagctaagcattttgtttagtatgtttctaatactatcaagcatttcagaattcacaaagataaaaaaatccagttctctaaatactttaatgctgtagcatatcaaactcaggtttattatataaaccatataaatccagatataatagcaacggtatgtggctcagagttgtgggtattcaaagacaagtgaaaaacagaatatattttcctagaacattaggttcacggaaactattttggaaaaaggttttaaaattttgctcatcaactgtaatcaacagagtcagatttttcaagttactcaatattgtgttctttccaattgtgtgtttcctcggagtagaaacagtcatgtaacttaaaaataaaagaacttggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccaggtacttgggaggctgaggcaggagaatggcgtgaacccgggaggcggagcttgcagtgagccgagattgcgccactgcagtccgcagtccggcctgggcgacagagcgagactccgtctcaaaaaaaaaaataaataaaaaaataaaagaacttgagtattactactgaagttaacataaacttttcaatcacatcaaatgaacagggccaatgctagaacaacagggactataggaactagaatccgtgatttccgcagatcctcatgaatcaattttctgaaaaataagtttatagccttaaatcagacttccttacaccttggttaaaccaaccagcaaacaaaactttctcctacaaaatacatccacttctttccaaaaccacttcctttaaaaaacgttttagtaacaaacatactattaaccttccttcctttcacagtatactccccaatatataaagcatgttgaaaattacgcatattgtaaatggtttaattttttaacttcaaatcttaatatattcaattacaaaagtaatatatgcccttttataagaactgaatacaaagttatgtaacaataattttctgtctccaacctaacatctaattctactccagtgagctagattactacctttctatagttttccatgctcacacaacacgttttatgttgcagctttttgtgtggggtatgtgtgtgtacttcttgtttctcagtggggtctacttacttaaaaacatcagtcagcaattctttgtgtgtgtgtgtgtgtgtaccacaaacaggtggatctaccaccaggtcaataaatatgactataaaattccaaaaacttctcaatattacatattttacttaacaattttcttaatgatggaatcatagttttatttccctagaattttgctgttaggaataatgctataatatatccttgtacatgtgtgatggtgacttctcttactaggggataaattatggtgaaaatgacaggatctttttttaaccattttgatatacattactagacaattcaccacaagtttgtagtaattcacaatccactagcaatgtatgaaagagcttagttgcctgaaactttgccagtgctagacattattaatctcctacatatgccagttggagactgaaaagcattttataattccctggatactaatgaggtggagcatcttttcatgtgtttatcggctatttacattttatttttagatattgcctattcatatcctttgccatttttgtcatttatgtcataaatatattctcaataattttcccttcacttgtgtagagtaactttggccacacaatagtttgttgtttctctttaaaggatattaagaataaccaaaaaatgacataatgtttgagataaagctatagtggatttttagaggaaaatgtatagcatcaaaatataaatcaggagacaacaataaagtattgaaaattataaagtgtttttttaaatgcacgacaaaaaaaaacccagaacaccctctcccttaatcaacgaaataggagtaattttttaagcccagtgctgtaatattttggttgaatctgctttgggccaaagtgaagcatccaagcggaaaatggggttgttattcatctaagtctaaaccataaaatgtaatacatagaaataatttctgaataactggttgaaaatggaggttaactagatactgtatttttctgggattaaaggatgaatatcaacaatattccttattctttgccacattcaccatttcatcccattattttttatgatgtcttcatttcccaaatatttaaaattaaaatatgtgaagaaaacatcagtagggtaagttttttgtcttatttctttttaattattaaaaaatatgacattaattggaaaaatgaatggagttatgtgcacaaatgatgtgaaatccatgaaaggcagaagcatgaggggatttcactgcatctaggcctggccactttccaaattcaaggaacaacagcctcactctcaaattatactttgtctccaagagtttattttttctcaataggtttatttcagtgataaaacagttgaattatatacatacgaagtttccaaaattataacttttagtccattttaatcaaatgggcatgaatgtggacagtttgctcttctgaccttcactggaagaaagtgtaggtgtaagaatttttctccatgaagaaaaaatgatgctgtatcagaggttaaaaactacaagtaaaacaacttaagttaattgttcaccctaacacagacatttgcacatttggcccattaaagtattcttacaactttgggcatgattcattttttaaaaaatgtaaagaaacagtatatttatggtacatgaccaaaatgctgcaatgaaaatgaaatttgaaaattgaatgaagagagttgattatgtagattgcaaggctcagataatttacatgtgatgaaaattacagtatcagttttaaaattaatggcattatcactcatcattattccctgaactgatccttttatgagattatcacagagacaagagaagattgaccaaaagattagtgaccctttcatctcatcataatccacaagtggcttaacttgtcatcaaaaaatatacttatcaaaatttctatcaacacagcctggaaatattgcactgtactgcttctttgacttaattctgagtatctcttactagtgattatgttgatgtattttacaagcagtgaaaaaggaaactgatggcatctctccccacatgactgtatgcaatcttcaatgctatgacagctcaagaatgataatcgcctcattgctgaaatgaatatctgacataagtatttaatttaaaccagtttcctgaacctgacaggatcatagaaacagtatcccaccaatttacctaaagggagtagcaggggaaaaaaaaaatgtttgttcccagatatggaaaattcatatatcattttaatgtcaaaatgagcaaatcttataggaatctaacatactcaacattatgcttattttttgtttgtttttattattaattttattaaaatagaatgcaatctctaggagacaagaaattttcctgtatttcattcactactgtatctgaagggcttaaacagagtctgacccattctagaagttcaaggaataaataaaaaatatattatatgtagaataaaaatttgcattattattaaaattaaataaagacttcatagatattgccttttgtgggctaagggcctggatcttctctagtagtcagaggcttctttttttactattagtggaatttcactggaaaatttgatatgtagtcccttgttgataaaattcttaaaaactgacttgctacacagggaaagatgttaagcatattttaattttatttttaatcaactttggcgatatataaagtaacatttttatcaaacatattaaatatttcaacttgaactgaatagctatattgttatccttgttagaataattaaatattggctacaatcatcaatagaataacaagtataataaaattaaattgtcagtgcatatgttaattgcagagaggaaaatattctagagcttaattttcaaatggtctttcaaaggaagatcatactaggtggcattcaagttgattttctctctcactaatatatatttatttctatcagaagacattttaatacaattgagtaatccaaatatttcaatgctttctacaattcatacaggaacttatgttgcataatgattctactaaatgcaactattaataccttttactcttctactgatttcattaattattataactaacatcacgattattattttaaacagcttaaatgttgactagttctacaaagttatcagccctctattcactgacacattgctgaaatcattaaactggaaggggctttaagaatgcaataaacgtttgttaaggtgaattgacactagtgcctatttataaagttatgaagagaaaatctatattgtttaaaagatctctaaaaaacaaaattcataacctctcaaggatttaaaatcttcatcttagtacattttttagttctcatctaaagcacttatacttcccatcctcttgttctgcacttggtggagatgttcaataaatatttgttaaatcccatcttcttgttctgtactcactggagatggaaaacagctagtcttctttctcttataagaacccttcatccttaaagactgttattaactccccactcttctagtctcaagcctgaacaatccaatcttttagccttccttcatcatcctgacttctcttaagtctcaatttatacagacgcctatctcagaaaacctactcagggtctcaatttcccttcttattaattgagcttaaaattggaaaagttacccaatgcatttaaccaatttttaccataatcaacaaaatattgctttacagcttctcactatagcaataactcacccctacacctatctatatgttcttttgaatataaataacacttcaactcactagaacattcagatttagtagaagaggctattttacctcatagcaaataatatgtttctcttcagtataggcaacaggattttatcttaacttcccttagcataatctgattgtctggcccaaagccatcatctatggagccttctgaacaatccccagtggacattacaatattgactgtgtgagaaattttattttcctagacaagttagaaatgtgaacttggttttctttaacacttatttatagcattcaatcagactgaccttgtttgatggaatacctaaaggatactcatgtttctttccataagaagtcaaatgttcattaatttagtaagcaatactctaaacactccataattattttcatatgtacagcatttgtatgaatttgatctgtatgaatttcctagaaaaaaatttacaatacttttagagtttattctaaatatttattctaaatattctaggcatctgccctcataagcttacattttaatgaataggggagagatgatacaaatatatacttaaaatatctttttaaaatatgaaaaaatatacatacttcaaatgtttacatttaacactatgtgataacctcagatactatcagagtttatcagatagtgttaaacactacagggaaagaaaggagaataaagtgatagggaaataaagatctattacaaacagaatggtcagggaagacattttcaagatcttaacaaagggaaaggaactgcaaagaccctaaaagagagtcagtatgcctaaaatatgataataaggtacataatggtagaaggaaaaataggagacaggtttcagatcacagagaatcttgccaaaccatggtgatactgcaatataataaaaaatacatattttggttttcatccctgttttctggcacacagctcctataagctttgtaatctcagaagtcgtaagtgtctttttgtatgctgatgagatgactgatgcctggaggctcctgtacagcttcagaatgggggctggttgccagtcaatcaaccgtgtgattacagagttggaacttttagccccatcccctatcctaggagaagggagaggggctgaagtttgagttaaaaatgaccaataatttgatcaatcatgcctacataatgtaacccttataaaaacaaaagaaaggggctcacagagctttgggtcagtgaacatgtggaggtgctggtgataacagcggtggtctatctggagtggctgctgtgaagacaccagctgcagctggggaggtatggctggaggaagcatggccagcgctacaccctccatagggccagcaggagccaggtacaggtgggagccccacacacttctgagttggcagggtgggagccttgccctcttgggtgcggctgcagccacccagctgtggctccagacctgggcaaccctgccttctcaggggcctgggaaaccccccactgcccctgcagtctcagaagtgcctgctcccactacctggtctctccccacccaggcacctgctctgattttggagcaaagttgtgcctgagcccaggtgctgtcgcaacctggctgggtgtgcacacatttgcagcagtgctgacaggccagctgtctctcaccttgtgcccctctggactttgggtaccgatgaacaacagtggaaagcagggggtgctgaggggtgctcagcatgggcctgcaggcactcttggcacaaatagcctgggcactgtagattacctgatcaatggcagcaatacgcagacagcctcaagcatggaaaggggcgggtccccagtgaagccccaccttcaagccagggacttcctgaagcatgagggctggactgtcagttccaggtggagtccctggagttagaacttacagtgctttttctggacctgcccacagccacctatagaccaatcagcacacacttactcccttctgaagcccatacaaactctggactcagccagactcagagacatcaggacaaccagctgtggaaaggagctacccaatttgggtcttcaccactagttgggacgacctgcctacagaaagaagctacccactccaggtctcctttctgctgagagctggacactcattaggacgacctgcctgtggaaagctgctaaccactatgggtctctcgagtactgttctgtcacacagtgaagctcctttctaccttgctctccctccagtagcctgcgtacctcattcttcctggacatgggacaagaactcaggacccaccaaatggtgggaatgaaagagcagtaacaaaaatagggctgaaacagaatcctcctactgctcgccaggttgtgggagacatgaaggagaggagagctgtggcccttcagggaggccagacctaggggttacctgatccagggctgtcacatcctctttggggctctgtggctcctgacatttccaagcttccgggcaccatcacattcccctcatccacgtgtgggtgcatacagcagatgccgcatgtggtacatctgatccagctgcagcctcacatggagccgggacctgtaccagtgcctggagctgcccaccctgctgcagcagcaagcatccctggctgtgtgcaatgggtggaccccacactcactcactcacacacctcttgccactctgcaactggcttgccctgggcaggtatgggatccagactggtggtgcgagccgagaacagcctgctgggccgagtgggcagaatgagcccaggtggcatgggcaatactcaggcagaaggcgttgttgaacacagaggtttccggctggtgaagtgacacctcaaggatcacgtgacactgggatggtggcacaaccaagacaggacatggaagctccgtgtcttttttccccataccttgctctatgcatctcctccaattggttgttcctatgttgcattcctttatttaaaaaaaactgggaatctaataaataaactgttttcctgagttctctgagccattccagcaaatgattgaacctaaggagggtgctcttgcaacatctgatttatagatagttgttcagagacacaagagacagcctggacttgtgtttggcatctgactcgggggaagtcttgtgggactgagcccataacccccaggatgtgatgctacatccaggtagatcgtgtcagaattaagttgcagaacacctagttggtgtcctcagagaactggagaattacttggggtgggaaaaccccacacatctggtattagaagtgaagtactgagattggtatgaatataaagaagaaacaatatttgtttattttgttcaacaatgataatgtttgcatttattcaaattacagtatgaagtctttacagggaaatagttatgtagcatcattgtcttaaaatcataggaaaacaatcacatcatactttctattttttaatgactattatttgttcacctatgtttaacttctcaaaatgtacaactaataaaacattagttcatcgtatgttttcataacagaaatattcagtaagaagtacagattttcaaaaaaacagcacttttcagttgtgaaattcaaaaccataaagtggagggagggatggctgccccaggtatcatttttagctattcaccttcaaatcccacttacactttggaacttttacctaagaatcagtcatttatttccaacggattgccatgaatttagaactggactatgtgaatttagaactggactatgtgaatttagaactggacatggagttttatatttttcctcaaaataactgtctttcttcccaggaaccacaaaataaatttggaatacagtgactgctaaagaataagaatataatctctacaaaaacacgtcaaataattactcaaacaaaaactctctccatttacataatttcttaaatagaaggaatatgtaacatacaaactgaaaataaatgaaaaataaaagtgttacaaacttaagcaaatggtattatgtcttcaacatacctatgaagcttaataaaaatatttaaaatcattctttgaaaaaggattcctagtgccaaaaaataaaaagtagaacacatttcaaacacaggcatattctaacaaaataacagaaggtattgtcaggcagggaataaaggcatgctaattttatctgcttaaatgaagggactcaatggagcctgactctatttattgactctgatacttattgacaattataaaaaacaattcaattatgtttaaaatttaatattaagtacttacagaattaaaatatagtgtatgacattaatcaggagaaaaacttaaaatttcagcaaaaacaacaaaagaaagaaatactatatacattgtaggggtgggctgcgagctaatacagcatttgaatgcaagtccaaatatgtaaattaaaaataaggttaaacttttctattaaaggaaaagattctcagaatcaaaaataaccaaataaagcttactctgtcatacacaagctatatctctatatcaaatgccagaatttaaaaataaaaggatgggctatgtgaatgcaaagcacatgattgttttatattcataaatggtgaaacccacaaagaacatacaataataggaaactaaggtgaaaatatagcatttaaaatattaaaatattcaatgttaatgaaaattgttatacccctctaacgaacaagagaaaatatcacttctttttttttgagacggagtctcgctctatcacccaggctggagtgcagtggcgtgatcttggctcactgcaagctccgcctcccgggttcatgccattctcctgcctcagcctccctagtacctccaactataggcgcctgccaccacggccggctaactttttgtatttttagtagagacggggtttcaccgtgttagccaggatggtctcaatctcctgacctcgtgatccacccacctcggcttccaaaagtgctgggattgcaggctgcacaaataccacttctatttaaaaacatttaagaaacttttagtgactattttccaaaaatgtcatattgagtgaagtgaagtaaattcagttcatcttttaagaggatgtgaaagtgttactttagagtattcaggaagttggactgtgaaatgcaattatattttatgttattagggcaacagatgtattagttttcttttatgcgtatctagcatgaaaatatcaagcacaattattatatacaataatgcttaatttgatatgaatcagtgctattgcatcacacttataaaggaaagattatgttgtataattaagtataagcagaatctccctctgcatggcaccattaaccagcatcttgagtattacacttgttttagagaagctcaaataaagaacaaaggttttcagaggaaaacaatgaagaaaggtttcgggatttttttctgtgtattataaggagattaggagtcatatgtctccaaacatttgaaattggatcaatttaagcttgtctgagttgtaagtaatgactgaaatctaaatattagaaagaaaatctgtatatatcctaaggaaatactcttaaatacgtgaaatgatagtgattacaattacaccaattgaggcattggttatgatagcaaaaaacaaaacaaacaaaaaaagccctgtataaaaatttaatgattagctctagagcattagataaccaaattaccatattattgtgatactgaagtcacttaaataatgtgtagtataatacaagattatgcaaaacatttgcatattattttaaatgaacaaagttacaaactaggaatatacactacaatctcatttttaaataaaaatatagacatatagaataagattaaatgaacacacttcaaaatgttattgacttatttctaggtggtaggatttcaagtgattctatttgcttttgttctatgtatatgtatttcctgaattctgtacactaaaaatcctttagtagttaactcttactgagttcttactctatatatggcattgttctaagcaagtgctttatatgtcttaatttgtaaacacttcaacagccctgtaaaagagccatttctacattcatttttttttttttcgccagctgagaaaacggaagcccggagcttaaatgacttgcctaggtttcctgagtagaaactgacagagcctagatgtgaaccttagaagtttggcaccagaaccagcacactccaagcactccacaaataagaactgtattatctttcataattttcaaagaaccttaataataatgataaaaataaaggaagatatttgattaattttaagtttgccacacttgccattcatcacaaagatcagttctatctttatttctacaaatttacaaattttatttctacaaaattacaggaaacaatactggccaatattcctcagcagtgtttgaatagagcttttcctgaagacatgagtgtcttctaaacttttaattttgtgactttaacaaaaacaaaatatcacatgttgttgttgtcctcaggagcactaagaaatttcctgcctgagaagtaaatgactgaggggaaaaaattatagaccattatggcatgctaataatccaaattagataaacaaacacaagcaatggaaaggaagaaagagcaaatgcattcagcagagaatggtgataaaaaataatggacagctcattctccacagctaaaattgcacaagctgagctgtctaagggaaatgagtcatctgtttctcaagttataagggaatcttacagaatattttgagtttgaatagctaacaccgcaggcaattgaaataggtctccaaatatctgattaaagtcatgcatgattacagctggtatagaatatttttgtacctttcttgcaaatggtaaaatgtaggttaaatctctaattttctctgttacttaacttctaaagtaggtattaattaaagaaataaattaagatatgcttaactaaattcttagatatgaaaatgaagtatgaaactttttattagtacattattcacttttacaatgcttcttaatgaactatttggtcctttgattcaacagtccttttatctcatatgaattctttaaaacaaatggattttctggagtagaatccggttttaaatatctaaaatatcagcctcagaatgccagagtgactgaatagaaggaaaaatgagaagaagaagaatataaagggtgctgtgcaatcatgacagataaaaacacaggagatcacagtaaaaataaaactaccaatagtgtcatctatagaattcggtcacctattttttccaacttaatttgatcgagcaaattgcctacaaaaaaaccatccagcaaggtgatttttgtacttcattgcttataactataactccaccatctgttctataaatgatatattaaaaatcaaatcaatggtgatttttaaaacacatgtcctttttaagaatatgatatattatctcccatgattccttaccaatttgctacttcacagaaaaaaatgaattgtcctctggtttcttaaattgtctatgtaataaaacacagtaacacatactatgaaaagctgagggtaaaacagaactttaggatctttcataagttaaatatgtcataatattttgtcatttcacaaagcaatgatgctcaaggagatattatttgaagaacagatagccataatctctattaatacaaaaatatatagggaaggacattttcatttagacttttatacactatgataagtttctaacaatttataattttggaacataaattatcattgtctaattaccatatatatatatatatatgtcacttctgttgccctttatttaatactcttattcaaataagtaagtggaaagtattgcttatgatgaggtcagattaggattctccttatttttatgttagtgtaatatgtcacttcattctttattcctttcaccaactatatgtattaaatctcctagatgcacatagtgcatgtaaggtcaaggtcaaataaaggtaaaacacatgaatggcatacagcatcacggaaattcaagaaaatatagttataatttaaatatgcaggtgcattcggacctcccctatgtagtcttttcaaatctctacataatcataacattttacagaaagtttctgtcccgaagtccaaatatgatatttaaccctagtcctccaaactcagcaaataccaggccaacttttgaaatttctaccttggctaatggtgacagtagcaaagaaaaaaaaaaaaagaaactgggctctaggctctaaacaaatatatgtgaaagttttctatcaattataatgcactatacatgaggattttctgtctacatttgtctacatgtttgtgtttgtgtttaattcaggaaaaccaggactgtaaaaaagaaaatgcttaaagcttgcatctttgaaccaggcagaaagtgcagcaaaccaacatgacacatgtatacctatgtatcaaacctgcatgttgtgcacatgtaccctagagtttaaagtatagaaaaaaaaaaagacataccagagactgtgcaatttacaaaaaaaaaaaaaaagaaagaaagaaaaagaaagtgcagctacctgatgcctgaaggaaaccaaatgaaagaatgtggaaattaagccattcaagcattcaaggaccagcactaggaaatttcaagtagctattacctagatttaaaaaatcagaaatccttacattaaaaactaatcatttgaattctgttttaatttactttctattttctcttaggtgggataatcatacctgattagtgctattataacataacagtgcttattatgtgccagacctaaggagtcacatacataagagttattatttactgttattactaatattagtatatattactttcatcctcattttataaatgaggaaactgaggactagacagttgaagtaacctcctcaacatcacagagctggtagttttccaaaattcagttttcccatctttaaactgaagaataaaacataataacatggaatctattacagtaattcttattgtattaatgatgatgttatccaaattgtacaagtggagtgtagccattgagcaatgaacactgcatttttatcagtgatttccattgttaaactgctttgtataatgccaactatttttcgtcttactcaaattcaactgatctgatgctcatatagcaactttctgaatacaatttgactcccaatagattttcttcttcaaggatgatgatttctcaggttaaatcaacaacatatttataatgatgatgtgttaccccatgaagctgaaacacaggcaaaaaatgatgttcgtcacaattcaaatactcatacacattttcctcattataatttagtaagctggcacactggaagctactttagcaagacttattcagatgtatttccctcagggatacttcaccaatttattattgaaaatcaattggctgtcaatatccaaacccctttgtatcatgacatcacttctaggcagaagtctcccctgatacccagggagcccattctgagtaatggttgcacagaagggcatcctagcacttgggcatgtgtcaagttgtttctcttgttttactgtagcattctgtaggtctccctcctgcactaaacattatgagggcaggaactgtcctctatgtataaatgtctgttgcataacccagtgcttgttctatcatagtttattatatggtaatatcagtttcctgaattaacgctcaatatcaatgtactgaattaattattgatttatatttaaatcaatccttcagaaacttctatgctgttagttcagttatgcacagtcttaagcatatcttcattcaataaactctctgggtattgtcatactaagtttctgaagcaggtgaactgctctgataaaaacaattaagcttgtgttgccaaatgtgggcttacttgataaacatcagtctttatgatattgctgagcacaaccttaaggctgattttgttcctaaccaagtgtgatacatattacactacatgtggcctagagtctataactagaatattacccaaatgaagattttcagtaaatctattaaaccatatgaataaattaacagctacagtttatttaaaatttagtattttccaaaatgttttacacatcatcttcaattatcttcagactaacacttttactaggaagtagacatgaaggacatgatcagataacaagagatcatcagataatgcacagaagtcaagtgacttgtctaagattgcgtagttaacataaatagtgttctcccactttccagtattgttttgctttacaaaactatactcagacaattaaaagaaaatgttataataaaccagtccatgtggaggcaaatctgtctcatccttgcaaaaaatacttatggccaaaaaagaatctcatataagaaaaaaaatgaaaagacatttcttataggaacagaattaaaatattgctttgtctcatcttcctgtctgttgctcacacatttgactgctgattatattgttaactcttcagaataaaaaggaaataccaattcaccatttctattatccagaaaatatatacataaaaagaaaacattcatattatttaattgtttgcctttttttcttgatttttcaagcctctatgcaaataaattttggagcaaagacagagatgtgcaagattctctgataaatttagaaacacaagagatttctgcaaaggaattcatgaaaatatctgtatttgcagatttttttacagatgttgagactttaataagcagcatctttaatatcatacatcaatttccaaaagtttatttagcttactgcatattctcaatctgatactcaatagtagctaaaaataacatataatacatttatgtaatacatggttatagttcaaagagccatccactacactgggaagaagctcaggtgccccaacactcctaccatgggagcagagagagttctattcagtatcaaatgcccccagtttaagattctgaacactagcatgtagaaaggcttttgtgtcagaaaacattttatcacattcaggaagagtttaaaatcaacttagatagcacattgctgatacgtgaaaagtttgaaaattctactgaatacttctcttccttagttttgaaagctggtattagtgaagtaagttgaaactcttggttcagccttccaaaccactcccataccccctgcttatgtacattcaagaccagccaaatacaaacaaaagagggtacagggtcaggagattcttgtgcccatcatgagcagggtgagatgtccatggccacagaacgaaaagtttattaagagaaggaggagcactggccaagcctaggagatgcaaatccaacgcagtttatgcttcccaacagagaacccatgaatgctttatgggtatgacaagaccttgatcccatcagctaagcccatcacctcagcctcctgcatatctcaggggccaggtgattctattatagtctctgagtgtcaggatgtgaaggaggtgggaaagctgtgttctactgtttgcttccccttcccaacctccactgaggtctgtcctcattgccaggcacttgttcggttcagagaagaattgtatacgtgtgttctcgaaagttcatagtggtaggcaggcttctggcgacctgagatagctcagcagtggcctcgggagtcacagagaacgtgttgttggccatggtgctctgtgtcaagctggtcctggaactgctatgacaggtgacggtagtgctgccagaggccctaagcccaggcacaggtccctgcagatttctggatgcaagtagggacaaagaacagactactggagtttttgtcactttagaagaaaaaacatatttatgagatttgtctcattcaaaaaaaaatggccttaaatcaactttggtagaagacaaacttaagaacaaattattagaaattcacaaactggaaatctttaataaagcactagaaagccccaactctttacttgggcttatattaaagactctcagaaaaggaccaaaaaaaatctaaatgtttagaacaatttaggttggtagcttaaagacagaatgtttcagtttttaggagattcatcgaaacacaattcacgtagctgcaaccaaaacagccttcgaaatacatcagaacaatgaagaacaacttcagacagcattgaaagacacttcggataaaaattccaatcttcagggaaacacagagctgctttcacaagaagctgaagagtggaaaagggaagagggagcaaacatactaagcagaataaaatgctagaaaattctaaaatgtgtaggaaacaagttctaaaatatgacaagtctgatcaagcttctgtgtgaacacaagttaaaggtgagagactgggctactgttcttggagacgacgacatggatgctaagaacttggatataaaaatgcaacagaaacggagacatcttagaagatgaatcaaaattttgaagaatcttactaatggagctgagttatttagaaaatcttgattcaaaaaacatgaatgctcactaaattaactgaaagaggggaggtcatattaaaagtctgcaaactgggaaagcttcaccgcactcagaaacaaactaacaggaaaacgcacacagaaaggagaggcaaaattgctggtggaaatttcaagtccttcttgaactgaatcaaagaaatgaaatatattttcacaaaatatcctatttagactgtgtttaccccataaagatagaggagaatcttcccaagggaggtgaaaagatcagtcatgcatgtgaagagatggacacctataaaatataagcctaaaagtttttagaaaaaaaaaggtcattggcctattatcaaagccagattattttcaatgagcaaaatactcaaataacaggttgacagttctgttgtgtgagtgaaaccttaatcatgtaagaaaacaaaatgcctgcacataagacaaattattaacaatttacatgtttcaaaaaatatcctaatatccttgatattccaagtgaaacatttagcagagacttctgaggaccaccagggcacactctggctaaccagatctctgatgaaggaggagtatcaagttgtgaaggtgtgcaaatgcaaggcctcatgcgtgatatggaccggatgccacccactacccagcccaggctcaggactgcataagcagggtccttccaacagaccactccctcctgacataggaggtcctccataagcgcaaaactgagtttctcctggtatctctggcattggcagatgctgcagacctcctttgggctcaactctcccactgatgtggagtttctggttcaggttctggtgctctgaatctatcctatcattcattctgttaaacggcagctattacaaagggatccccagtagcaggtactgagaagaggatcctctccccaacctcctattctataaagatgaacctctccaagaaccctatttcccagaaacttgccttgcccagtacatcttcccctgacaacaagaagggtctcaataccagcactggattttgtcttcagaccccatagcctgaaaaatagaagtgagtcaatttcctagctatcatggagtatatgtcttaaaagacatacactgaaaatagcctaaacatagaagtgagtcaatttcctagctatcatggagtatatatcttcctccatgtttcctggcatacaactcctaaaatccttggaatctccaaagtgctttctttttgtatattaatgttgactgatagcatcaggataaggctggttaccaaaaagaccaagccatgattaaaggattggaactttgagccccatcccccaacttccaaggatgggaaaaggagctgaaggacaagctgattaccaatggccatggtttaatcagtcacgcctatgtaatgaagcctccataaaaacccaaaacgagaggattcagagagcttctacatagctgaccacatacagtttcatggagggtggtgttcccgagggcatggaagctccacaccccttcttccgtagctcaccctatgcatctcttcatctgtatcctttgtaatatcatttacaagaaacaggcaagtgtaaacaagtgtttctctgagtcctgtgagctgcttcaacaaattagtcaaacccaaagaggtggtcatgggaatctcaatttgaagctagctggtctgaagttctggagacccgacttgatactagtgtctgaaaggggtgcagtctcgaggcctgagccttcagcttgtgcaatctaacactatctccaggtaaataatgttagtctgactaggaagagactcaactggtgtctactgcttggtgtatggggcttcttggtcaaacaagtcttctgtgtgaatgattgctgtgttgtatgagagcagaggaaaaacaaatgttggtttgggagtttttctgaaacataagttgatcctcttccaatgagtctgtttctaaagattcagaattatagcaaaatgcttttctcgtctctttacttaaggaattttaacttcttcccttttatttcttctgctattaagtgattatacagtggctcaaatggaagcttgataggactggaatctgtaagataatattttataactttagattattatttatatatgaagtgcataactaaattgcttcaatcttatttgatttgtaggccacgaattcaagtgtttttgttaagtctgctaaaataatccagaaacacaacaagtgtcttcaaaattatgattttttgttttattgtgttatggctatttaagtaattaggaaaccttgataggattacaattctaggatagtgttttaataaatgcagcttatttaaaagtgaatttcatgaataaattgcttcctttcttctacttccagatattataaagatagtacatctgtttttcctgtttgactagtcccattaacattggctgtaatcagaattttgtcagggaaatcttcagttaagatgcttgaaactcaaactttatttctgtataccaaagactaaatttaatcaagttatgatactaatatatttaccaaaataaactggtttaaaaaaaatgaaactacgtaaacatacaagcctttggggaaaaaataggcattactacctagtacttcattcaattaagtattatcaaatctttgctactgtcaaaacaattttaatagtagtcataatatatgcttaatgaatatatacatgaaatctttaatcccaaatgcagaatgtgtttgacaaatattatgtagcagtagtacttaattttgattcagcataacatgtcatgttacagttctatgaatttacaattcatagaacttaatttaactactacttaattttactcggttttcaaatttttactcaactttttctcctctgttatttctagtggtaatttttgataatttccctcctttttgaatcatttccttctttgttcttaaaaataagtgatttttctgtgttatgttttattcttcagctttaagatttctgtctgtttgcctattacacaaataactctaagcaatactctttttaaatataaaatatgtaagcttaaaaaaaagaatctctatggtatgattgtgttgtctagcaacaccattcaccacccttttcaataaagagcagcgtatggcagatgcatctgaaagcaataactaatatttatttggagttctgagctaaggaatccaggaatgatcaacctggagattcattccttatctataaagaacatctgaacctggcccctcatggggaacatgggctgtacaggggatcaaggccctttgtttcgggttaaaagttgtcagatggaggatgctaaggggagaacgctaagtgaaaatgctatataaactgcatgttttttacaagcggtagcagttctcctgtacagcccaccaccactggaccaccctatatgtaagttctcttggtaaaccctatgtgtccttcactagctccaggtctcttctttggtctcttgaacatggtgctatcactactgaagtcaacaggctccagcaagacaagcaacgacaaggattcctttctctaagtctctttagtatactagtatgcaaaacctttcttttactcattatttaataatagtaaaaataaaaataaatactcacgtatttactcattataaatgtaaacaaagatataaatgacaaagatatgttccactatgaatataaatatttgtaacaatttaataatttttcctcagattttcataaatatgggagatagaaattctaaatattaggctgggtgtggtggctcattatgaatataaatatttgtaaccatttgatatttttccatatttttctctgatagatcaaacgagatacctcagattttcataagtatgggagataaaaattctaaatattaggctgggtgcggtggctcacggctataatcccagcactttgggaggccaaggcaggccgatcacttgagtccaagagtttgagaacagtctgggcagcataacgaaaccctgtctctactaaaaatacaaaaattagctgggtgtggtgatgcactcctatagtcccagctaccccagaggctgagatgggaggatcacttgagcccaagaacaagaccctgtctctacacagataaataaaattctaaacattttttgagatcacatttaaacatatcttacttactacgggaaaacaattacaaagagatgcaaaccatatttgtactaaaaagtataaaagagaaaaacataaaattagcttactgtgggacataaggtattaaggtattatgaaattttctaaaacaaatgaaataaaacatatctatagtggaaaccaacacatagcagagaattatgcacaaagtaaaaaattaaatacacaaattccagtaaatatgaggcacctgagtactggacaaatctttaagttaaaaataaaatataaccagtgacattctcagtgcacaacgacattccatacaaatgacaaaccagaaactgaaatttgcaactgaaataatagatacaaagtcagttaacagaaaatggctaaaactatttctaacctaaaatactgaaaacaaaagccatataaaaacaactctagtaattaaaaaaatcacattatatgaaacattggaaagcattactctaaagatatttaatacacaaagaaaatgttttgtcctctcaaacgataaaaagctacagggtaaaaaaaaaggagggacttaaaaaagagatcaggacaacattttttaaggtttatatatcttttgagataaaatctagctaaataagatgaggatgggatgagagaaaggcacttatagaaaactaaaatgcaataatagaaacataaatcctttgtaagcattagaaaatagaactgacgttacagacagaaagacaatttactagtatcacagatcaatttgagatcatttctcaaaatacaccgcaaaaaatagacataaaataaattaagggaaaatgataactattttgtactagtaaaagaaattcaatacatggatagtggatatcttaaaagaataaaacataacaaatgatgcagaaacagtaagctgagtatagcaaaagaagatgctccttaactcaggaagaaaaaaagactttgtatcattgtaaagacttaccaagttttacacaaaagtagtgggaaaatgtcattttgagatataacttcaatgaattttaaacaaaaaaaaataactgtaaaataaaagggtgataaattcaaccaaattaaaaataagaacatttattcatcaaaatttaaaaagagtgaaaagatatgccacaaactgagggaagatatttgcaacacataaaggtaaaaattatataatttgttatataaagtgctcttcaatatcaataataaaaagacaatataacaacaaaaaaatggacataagacatggagttatggcacacaagagaaacatgcaaagccctaagcataaaacgatgttcaaactcattagattcatcccttactagtaatttgggaaaagtcaaattatgaatgtattgagatataattttacaccccaacgtgaaccaaaatttagaggatgacaatactaattgttggagacaatgcggaaagggattaagattatttctaaaatgttgctgtggaagtataaatagcataaacaatttgacattctgctacaatgttctacatttgcagcctctatgaccccctacactctaaagactcttttccacatatgtaccaggagaaatgtataaatgtaaataaaacaaagatgtcataaagtaagaaatgcaaaacaatgaaaatattcatgaatagaagtgtagatcctaaaatccttactattatttaatcactgacttagaaaattagaacaatctcagtttaaacatagttaataaggtcttaaagataaccactattattttttaaaggggaattttcctcctaaatcactacagaagacaataaaatataccagagtatatgtacgataaaacagaaaacagtaaaaagatttaaaaacaaactcataaaagcatttaacacttgatagaaacaaatttatcatttattactatgagtttaaatggtttccagtcatcaataatagactacatttttcacctggaattatatttaaattcaaacatacactaaggagaaacaagccagacacaagctgagaaatccaattaaagagaaaagcatagagaaaaaatatattaaataagcaaaaagaaaagccacaataatatactacccaagtatgacaaaagatacctctttggagactatccaacctaaattccctgaccagtcaacaactcttacttctccctattttatattcaccagtatctaaaattttgtctatttgtttatttctttattgttcatcttccttatctacactgtgcacactgtgtgatatgacttgttcaaacagagacctgacagtattgtttaaacaatgtaactcaaaaactcaaattaattggtatatgtcaaacataatatcccacagttaggggatatactttactctcaataaacattagaacattaaaaaataatgacctaatattatatcaaattaaaaacattttatagtcaattcaaaaaaggcaattattctatactttctcactaccatgtaagtgaatgagaaaatgataacaaatatagcaacaggaaaaacatgcccatttggacaaaatcatcacatcaatctcgaatatctactaggcaaaactgtaatacgaaaaatacttttcaaaaaataaaatgagaaaatgtttatacccaagacctatccaagctgtaatcattatttttttaatcttagtgatatattttactcaagaagttatgactgttaaagcaagaaatgataatagtgaaatataataataatgatattaatcattaggataaaatgtgatatggtatgcattgagggcatccagcagaggaacatgacctaggccacagattcagaggttaccctcccctttctttgataaagaaatgccatatgatcatcagaatatgaaaaaattacacacacataacagcatttatatctataaagtaaaggtctgaaaaagggaagggaaacagcagttactatttgggagattataaattggtaatgcctttctagagaataatttgtcagcattcactgtttaaaccaacaattccacttctaggaagctatattagagaaccatgcagatatatacataagaagatatatacagagaggtttacggtcacatgatttgcaatggtaaagactcagaagtagtaaatgtccttagaaaaagatgattaaatatataattacatatgtatattatagaatattatgcattcattaaaattaatggaatagatcaatatgtactgcccacaaatcagttaaattctgccttgtatgtaacaactagcagaagacttttctagaagtctttatacgatgaacaattcattataacgctaagttacaatgtgatatataattatatataatattggagagcaaccaattttaaaaaacccttcaaactagaataaaaataaaataattaatgcatgtaacacagtaatatagatctgtccagaggcaacttatctctagagtcttaataaagcatgaaggtgacattggactaaagctaatttatataaaaccctggaatacagaccagcctaatttggcaagagcactcactgatttcgtgtgaaagggagattctagagtcaataaatatttttaagcacacaataaaatgccaggaacttagtaggtaaaggaacttatatccttgggaaaaaagacaagtaaacgagcaatattaatacaatataagtaagttttaaaactgtataatgtgattatttataagtgtctgttgtctgtctttccgtgactagaatgagagtcccatgaagcaaaacttttggtctgttttgttattttccaaatgttaaggcagtgctaggcacttaataagccctcaacagagattgattaattgaaagaaaaaaggacaaagaaaagcagaagcgggcagagtgggctatattagagggaggctcagggggctgggggcctgggaaagattcattttccagaaggtatgaaatcttagttgaagcctgaaggtcaagattggattcagtaaacatatttgaatggtgattgttttcaggcctgagtcaaagagatgactctaggccactaaggagtggaattgatttggaagaaaggaagttacatctgaaagaagtctagtaggcatctctctcttttttctctctctctcccctcctccccccacacctctgtagataataaatcttgataagagaaagcttaagacagatgttagataaaaactgaggccaaggaagagatgggcagaaggaatactgaatagtgaggatggcgactcgagaagctgttctaagaagaaaaatacttcgagaaggaaggtatccacagtgccaaattatacgaagttctggtaaggaaacacatggaaatatgttcaccagatttattaatagtaacaaagaggtcatttgaaactttcataacagcagtttcaccggtgcagaggaggtgaaagccacattatggtggctttaagagtaagatatgagagcctggcatttctagagaatggatagtgtttttgaagcctgattctaggtgagggcaagagatttatttagctggttatatctgtgaatgcttctagttgtaataacatactttcacttttttttttgaagtaacaaacctaggctatgtgtttgtagaggaggaaatattgctgcagaaggagagggaaaaaatgtctactgccttgtatgtgtctgcttcttccataggctttgggacattctcaccagggggtttgagaatcaaacagtataagacaacttacacaacaagttggtcaggtaaagacttgtctgcctattatttggattttataggaaatttaaaataaacagctctaacaagcagagtaagcttgttgactgaaccatatgagatgcatttaatttttctcaccacaggtgttctcaagcttctatatactctgtgcttgtggttgttctaagataatatttctgaaaatatggaaatatctctggggatatttgaaaataatttatttcaaagaatatggaatgttaagacctaaaatccatgatttattcaatactgggtattcattcatttatgtgatggaaaagttaccatagactttccatctacattttcttattgcatcttgttctgttccttcaagccatcctccttcaccctctgattaaccacacagttccattcttctcacaatatataggcagtaaatttttttctaaaaataacagtaaatgtgtgtgtttaacagtataagaggtagatctcaaatgagcgtaaagatcaataacaattatgtgccaattatactatgaatatgtaattggcagaactgtatgggcagaccatgaagactgagcaacagcaattctgatcgaaccatgccctaaatgtctctgcctaaaaccccaggtttttaaaagaagcctaatacaaacaagtacctaaatgaattgaaaatatcaacactggcatatatttgaaattaatatatacaatacaacttctattttttcattattcattgaactattgagctataagtggttatatacacataggtgaaacaaagaagactaagacacaattccctaccctctagtaactcaaattatctttgaattaagaagagtttactatattgtgaggttttctctaatttgataatagaagagatggaaatgcatgcagttacatggccacagacagataacttccttacttagcattgggataaatcctcaaaaactaattccaaaagtatatctaaaataaacctctattttccattcattctcctaaccaccttgccatagactttgaagtggaagactttcggttcagttgagagatgccacaggacggctcgtgcagagcaattactcatgtggtggctaagcatggcttccacaagacagcttctttactggccttctgttaatgagttagaggtatgacaacagatactgatggatgtgtttaaagaagcaaatgaatttgaaaaaccaaactttaaatgtgaacttcaatttttatattgtgtgactgtattttttatatcattgattagatttgagatagtagcatagtttagtctctggaatctttgtttcattcatttaagtagccacgaggtgccaggtattgttgtagaccctgaagttacagttgtgaacaaaactgactaagctactgctctcaggaaacttgaaccctagagacggaaagaggcattaggcaaaacagtaaagatagagatgataataaattctgtagagaaaataaaatgtagtcaggagtaataaataaaatgtggttaggagtaataaggaatgctggatgatgaatgttacatatgatgttgcgtgttaggaaaattcacactgagtagctagcatgtgatgaaagtaaggaagtgcagtatgtatataaaacaacataaagaaaaggtagtgcaaatgccttgaggcagaaggccgcaggaagtgttcatgaaaaatcaaggaagccagaagacagtgactaggagcctgggaaaacaagcagcaggagatgaggataggggcttgtaggctataataggaccaggttttattctgagtgacacaggaagacaatggaaaacataatctattttaggtttcaaaataataatacagttgcattttttttaatgtctgaggacaaggggagaggcagagacatcagataggagaatattagagttcaatactgtcattagacatggataacagagggtcactttagagaacctccatatctcaaacataaacacaataaatttattaaacgagtgcctgcttctgtcagtctgatattggtattaagagctcacgtagttctaaactctgtcctaactctggacctcagttctcataaccaaccgttcagtctgcagtgaacactcctctacatcttctgtcttatgtactcaaaaaaggaagaaccatatgaataattgtgggttatgccactgttgatacgagaagaaaactgctttgaaatgaaggaaagatttgagttgtagaagcctttaggtaaatgaaaaagcaaaattaactactcaacaaaacactaacaaaccaaactcaacagcacattaaaaggaccattcaccataatcaagcattatttacccccaggatgcaaggatggttcaacatacacaaatcaataagtgtgatataccacattaatagaataaaggacaaaaaccataggatcatctcaattgatgcaggaaaaaacattggacaaaactgaatatcctttcattatacaaatactgtaatcattaggtgtagaaaaaatgtacgtgaacacaataaaagccatgtatcacaagctcacaacgaacatcatattcaatggtgaagagctgaaagcttttcctctaagatcaggaacgagacaaggatacccacttttaccatttctattttacatagtactgaaagtcttagccagagcaattaggcaagagaaagaaataaaaggcatccaaaacgtaaaggaaaaggttcagttgtgtgtttgcaggtgacatggtcttatgtatagaaaacccgaaagccaacaccaaaaatagttcaaactaataaacaaattctgtaaatttacaaaatacaaaatcaacatactaaattcagtaacatatctacacattaacaataaaccacccaaaaaaaaaagaaatcaagaaaacaatcccatttacaagtagctaaaaaatatataattaagaacaaatgtttccaaggagttaaactatttatatcatgaaaaccataaatctttgaagaaaacaattgaagaagagaaacaaaaagtgtaaaagttgtcagaatctaaatggagtcaacggcattaaataccttgacaaatggggccacagtaggccataaaggaagggttctcacatacactcttgataacatactatcttgataacaagaactatcacaaaagacttcaaatgatatctgtaatttattactaaaagataaaatattattcgaagaaatcaaagctaaatgattaatcatctgaattaccaattaccagtcattaccaatatttaggtaaaactaaaatattaataataaaaagtactacttagtgagcatttaccatgtgctaaactttgtattatacccttttaaaattcctcagttcatttaactctcaaaataatgtagttagattaccataattatcaagatttctatttaacagtgaaagaaactagagctagctagttaaggtgaagaatcacacccaagatcaagttagtaaatgtagagacgatttcagtttgggcatgtgtctctgagtcagagctgattatattataccctactgcctcacacaacttaatcgtaattttaacatatcccataaaaataaaacacctctatctaggtcattaaaacttgacatataccactgtgctccttaggattttttggttgtctatatctcaaacatgatttacatagtttaagccaataaaaagagtctatccaagagtatctcacaaaacacaaagttgcaaaactctccctacacaaagccatgagaaacctgcgcagcttctttttctatgactgcctctatcttctctctcctcagcctggccttttctgattttcagtacatgttgcaagtggaaaatggccaccctgcagcaccaagctttcattttattcctgctcaaacagcccagaatgaaaaagaatctcttgtcatagatatctaggagagaatctgatttccccagcctcggtcagttctctccatcagattcaagtggccagaatgagggccagagttaggtggtacaaagaaagcttcaagggtctatgccaataaacttgtggatttgtgtggtaggtaccttcagaagtatacatcacagtcaaatttatccagaatttgtgataaatattcctatcttctaggaaagaatcctataaataagaaatataataaacaaaggaaacaatccaaagaggctgtatgtgagggggtcagaatgtcaccgcaaaatatgtcaccttggtataaggaccattttgagctgaaagcacttaagaaacaacaaactgcagaaagagctctttgctctttgctctctccctatctgcctaaaagcagacataaatttccttttgtgaaggtgttcccctcccttcttccataccaggaggagaacaatcctttatcactggatacagaaagttggcaccaagatggatttgcacaaacaaaccttgctaaaatagcccttatcttccattggtatccctcatatatttatcttcccacaatttatcacccctagaatcccaaaccccttttcctttgtgttatcacttctgcacgatttatctccctttattaaaatggtatgtaagcccctgggtttaactccttctttctgtcttcatttctttcatgtgaaggtcttgtgcacatataaattaaaatatgaacatcaaatacaatgtgtatgcatgttttcctgtcaatctgtcttctgtcagattaattcacatgccccagccactgaacataagaggttaaaggaaaaggtttttcttcccctacatacattacacataaatgtagtatatacagttattgatatttggagctccatattcaaatattgatgttggaattttaactactgattcaatttgcaaatgctgaatagatattaacatttttaggataaatcacatgaaatattctggggaataggttagtaaaatctaaatagatattagaaatttgaaagaaaagagaaaataaaatattccattctgtctcactaatgactactgaatcaaagcatgaccatgcaaatagggtataacacattttttttgtaattaaagcaacttcaagataggtaacattaaaaatatcctggcttaatgaaaacaaaaatatgaaatgcagttaggatgtgtggatctttatcgtgttatataaaaatacaaatatttcaaaattcataaacttcaataacggagagctatgacagcagagttccacatttttgttcatattcattttaagtgcatgactgcaggaaggcgtttctcatgctatttctctgtggtccctgatattcaaagtagtacatgcaatattaatgatctcacttttgtgagtatacagcatacaccacattcccacctaaagaaaagctcctcaattcctaatcatttcaataggctctaatgtaatatttcctacattggaaatcacagcactttatttaaggaaatcagtttggccaagtgagctctatggagtgcagcctgcacagacgtcagttcaaaggatcagatgtcaaagtgctccctctaatgtcctttaatcatcactccgattagtgcatgaataggactgtgattaaaaacgctgctgccattgtctacctattcaggcctctagcattttacgtgggttccaccgattagtgtttgaataggggaacgattagaaagacagctgccattgtatgcccattcgggaaaacagcaaaactcacatatttatttgctatgagcaccaaataaatgttttgcaaaggtaaaatataccattagactctaaagacaattttgctgatttcttttgttcagagcactgtattttcccatatgcaaagatgtttcttatttgcaaatacagtaatatgcttcattaatatcttttaaaatatacatattttgttttcatagaaatagtcttaacacacatctgctttattatatactacttattgacctataatacatcatacaattccagtttaatatttatgattatgcaaagattttctgtgtaaacaaattcaatctatttggttccagatcttttggatcccttctcaatattcttggactaatacgtagtctataagaacaacttcttctcccaagagaaatttccttgtcagacacggagaataaatatttcactcttgggccattctaagagagggaacacatttcaggttagcagttagtagccctgcaggagctcacacaagagagcttcggccagagtggaattccccacgacaatacaaacctctatcctatgataaaaattctccaagaccaaggcatcatgttgaggctttttggagaagggagaaatacaggcaaaaaaaaaaaaaaatcacagaaaaagaatccatccatatgcaaatataagacagtgctcaaaaaaatttttgtggctgtttctctctctcttctttctgtttctgtagaaatatgctactaggaaatttctgggcaatagaggaaatattctgtcttccattaccatcctcagtatcttgctgctcagtacttctccatggtttttccatatacattgttctctatccactatcatgatgtgcttccatatgtagtaacagaaacctcggagcatcccccttataaatgctgataatgataagcaataatacttacataaggttatatatatgccaaccacgattttaagaatactatgcacattgactcatttactctatcaggtagatattattctcttaatttagagatgaggaaatggagacagtaatggaatcagaaatttactcaaggtcatactctagtaaatggcaaaaccaataattggagctaagcagattatccctagagcttactctcttaaccaaactctctactgacaactgagctctttgggttccactgcctgccctcataaaaacccaacctcaaagataaggaagctgtgaagggaaaatttttcttcttttgcaaataaagctaattgaaacataccttacacaggggaaagttttttccagttcagtttaaaccctgagtagataactatattccattaaccataaagttgtttaaaaaaatagagcaccctgcttaaccattattaaaatttcaaaccagtgaagaacaaaataaaagtaacaaggctgatggctgacaattacaaacgagtttaatttgtgtgtcacatggatgtggagaaagttgcaatcagtctgaaataaataattaaagcaaagcatttttgtaacagcctcaggaaattaagagttaacacttttcttctttttagtcaattatcatcttattacatatttctgcctggagaataaatctctgacaacactggtccatgtgtggaatgaagcactaggaaaaaacatacttttaaagagggatactaatatatatcaaaactctaaattacagcatatcacaaacaaagaatgtgcctttttaacatataacatgcacttctcaatgaaataaccagactatagaacttttcgagaaaaaaatatttatcatcatcatcattgtcactactctgtggagaggtcctcagcatcatctcttggtacttttcttcatgctccagtctacgacttcagccatgcagtactgacaccgtttcaatcccttaacttcaatcagtatgctcccccatcttcggactttcagatacaagttttctactctcgtgaaattcctctttttccttccttccttccctccttcatctttattttcagtttaaattctggttcctcagggaggccaaccttgaattctgagaccaggctacagtacttcagctgtaactcccatggaaggctgtactgacgaaacttgatcgtgaaatgaggttaacacctgtgcaaatgcccacttagctgtctgggcaaaaaccgttttgtccctttcccatgacttatcacagtggctggaacatgttagatcttccattaatatttagtaattaataaatatgtacaatttagattcaaatatttatactatataagtttcaaagtgaaataatttatatgtagtggtgttacagaaatactgaaaagtgtgatgcaataaattaattctttaagggggttcattactccagaaggtaacttatttccagcaattgaattaatgcccaaaaatattcaggagataatactcacagttcatacttcatatatatatataaacaacggaaaccaatcaatagcttcatattttacttgctgtttcagggtatactttgtattcttacagaaatctaggtgtatgttagtagataaaacttacataaaaattcttcaaaagaatatcaaaatacatttttatatatgtgtagattgagcaattcacttatcttcaccaagcttcgtatttcccattaataaaaagaggattataatcataataattaacaaaacaacagtaatagttctcatccaccagaatataagttttggaagagtaaagtacacagttgtattctcagcaccaaaagcagtgtttaacacacactaagatttcagtaaatattcaattgttatttattgcatacttactacatgtgtggcactatttcaggagctgaagatacagttgtgaacaaaataggtcttcacagaccttacattctcgtggggagaaaatgactaaacaaccaaacaagtaaaatatgaaaaatagtatgttagatggcaatatgttctatgaagaaaaataaagcaggaaagggagtataaggagtaaatgcatgaagtaatatttgcttcatagagttgttcatcaactaatttagttattataaacagcctggttcactatccaccatcctcattgtcttcatcatcaccattatcaccggtattatttgagatactgttacagagtacagcactgtgtcacacagctaaatcctttgttagatgcactccctacatcatagaacttcagaaaaaatgagtgaaatgtatttgcttctcagcacagagatggaaagaatatatgagaaactgaatcatataatctaaattaggtatttgtatcagatactcaaaaatgctttgtgtacattaaacatatcataaattcataaggaaggagaactacaaatattttacaaatcatgaacatttatgccacttatgtttacataatttacttgcagaactaggtgcatacagggtttttctcaaatcaagataccataagcaaattgatctctctatacaaatgtctaccaatattttcagttaaattaatttgggacaggaaaataatatatttgagaatccttaaaaatgatgtgattcagacactcagaggaattgctttttattctggaaatacaagacaaaattatcctaaactaagttgaactgcaatcttgcagttactaggactattgttcatatacctatgtttttattttcaaagagtttccttttcatgaatttccagtgctatggaaagctatcacatctaccaacaacattaataaaaattggagaacatttgcttcggtcaaaatattttctgccttctctctgtacatgctttattttatagtgccaaagacaacagagatttttaagatatgttatttttatatactaacaacaacaaaaaactgctaattaaactgatacaaactttcttatcagattaactataaaatgaatcttaattccagagatgtgaaactgtgataaaatatgcatcagagaattgatcaaatatggcaagtaccacaatgacataatgattcattgtttcatgcagaaatgaaaatcaaatggcataaaaatattaaatgaatgtatgttatacatttgagtcttcttttattctatgttagttacaatacagtgttgttgataatagcatttttagtgtcaagaattgccctgagttttcttgcctagatgacaaagtgattatttttgctaccaacatagcaaaagaaaagccaggcaggaataggcatgaataattcggtttttgacatagtcataatcagaaaccaatacaatatctaggtggaactatcataagaatcatctggatacagacaggatcttggatggagatattcatttggctgttaataaacacatagatgggcattaaaactatggagtgaatgtagctatcaagagaggcataattgagattttccactgttcccatcttgaaatctacaactagactctaaactttctacccaaaatgcctttgcataagcagccagttattattttaaaataaatacctgttgtatgtcagaattcatacaatgaaagactccacctcaacttcaaaattacaaggtctacaatatgtgtaaatgagctttatactctgaagggatttctaggtagtcacatttcacagtatatttttccctctctaatttttttccctctgctgaaattttaagctcgcattttctttaaagtgttattttctttaattttcctaagacacacacgcaaaattattaaatttacacattaataatatctaacatttgttagaaataagaaagctattgcccagtaatgatcacttaaaatatacttacttcaaagtaaacttttatttttctaattcattgcaatgttctcaacaaatgccacaggaaaattgtttttaaaatgtatgtatgccatttatgtttacataatttacttgcagaactagttgaatacggggtttttctcaaatcaagatgtcataggcaaactgatctctttattcaaatgtctaccaattttgagttaaattaacttggggataggaaaataataatatatttagtaatatattattcacagtaaaatcataccattatcaagtgttccaaaacactcaataatgcgtcatgactggtagtgcaattcagaagttaatgtaatgaccaggaaatcccacagagtgagccagcaagtacttctgactcaacctggacatccaaatccatctgggtcgctactgcggttttgcagttgctactgaagtttaaacacctgtggagacactactgggtcttgaggctggctggtacctccaggacagtggaagccctttgggccagtaacagggtgaagtaagtgaggcactgaggcactacatttaagttggcactcagttttaggatcacgcaagtaatgtcccagcttcccaacatggggttcctctggcattgcctgccctcgcctacctttctataatctttcccatcccaaataggaacttactctgccatctctccccactccaacagccttcatttgagaacttgctggatagagggcaggagatgatcatcattcatgataaattcaaattcaaaatcagtctttatgaggtggttgtagttttgctaccatcccttcccattccacctagaaatttatacctattaggcagagaagccactgggttttcatttcttgaaggaaataatataactacagaaagcagagaaacaaagggtgtttcttttggacttagaattttagaagtcacgttttcagaaaaattgaaaggacttcagtgattgacagtggatttaggaggaaatgggtgataagttaaaagtaacttttttcctccactcccatccttcccacccagtctatataaatatttaatggacagagagacaaaatgaggaccaaaagcaaagtgaagggcccagagatattggcagatcttggagaaagaggatcaatgcccagctccttaggctattctcagagggctgacaaataccaggtgtgggtaaatgaaagatggagaatctgtgactcgacaaacgaagccctgggagagtagattgaaccatgaacttctctgaaccccagtgttgagtggaacatcagaatgactgtcatcttttcaagaatggcttcaaagtagtagagaagtgagggatagaaagggttctaatgaatgaaaatgaaagatgactccaaagtccccatgatggtgaccagtgggaagatggcatgaaaaatcagctgggcttacctcacagcccacacttgccaccaaccctcataaaacttaggtatcagctcgcagaaataaggggtgagggggacaagcagggaaaaatgaatactacaagtgacacacaggtttccactctcacagatacttacaatagaattaagttcagttacaagaaaataaaagaggtcacgtgacttgcatgcctgagtttctagttggatatctgcatgctctatacaaacactgcatttttcacatactgaaagaggtatttagttgcaaagaatctgtttttatttttttatttcagaaactcaactactgtctatttttggaagaaaataattgtcaacaatcaaaaaagcaagctcatgcttgagaaagtattttcaaatatcatataacaggaggcaagggtagaacaggtattgctttcttactgggtatctggtgaaaagtttatttactttggagcttaaaaataaaaattcatattgtgaatttgatatgtcaatggagggacatatattctccatcaaatttaacagatcccagtagctggctatccatgaaagcgtgaatgagattgactgctagttgtactaattaagtggatttcatctcttaatagccatgtaaacttgagaaggaaaaatggtgccagcagacaagacaaacattaagtataatttccaaaagtataaaaattaaacgtatttggaacataagaaatattattagaaaaacatattaatctatccttcctccatggaagtcccctactatgctcttgtggttctcatctcacctctcatagtgcttatagctaaattctcatctctgcctgccttttccatgctacgttcagtaccatgctgagccacattggagcctgaggcaaaaggaaaaaggtgtgtgcctatatatatttattattattattgtttttctagattactgagtctttgttagccccttatattttgaacctcaggccagtgcctcacttgcctcactctaatttctgccctaatcccaaaggtctaacctgcaccctctttccactttacacactcttcctgggtaactctccccctaggcttttagttatttacatatatcctgatgattcaaaaattctttatctccatcccagaccctttactaatcttcaacttttgcagtgatccacaggcacaagacctcaaataatccaaaagtgagtttagtatttaccctcaacttatgctataaacaagtaaacatacacataaagtcaactcccaaatcatatgtgttttatctcctaaatcaattcaagctcatcctccctcctagtcttcatcacctgtcttccaactttctaaacccagtcccagagaccttgcctcccatcttttcattaaatccatggtccacactgaaagctagactgattcacctaaaggcaaatatgatcaactcacactgatcattaaaacgccttaactgttcttccttcaaaagagtattattattatttattggtatttcagtcttcttcaaaacaatgtgagaacttcttggcaaggcctatgtcacataaatttcaatgtggcaagtggcacagacaataaatgtgaaacaaacgagtgactgagattgtgaagctcatgcaagaaaaaaaaattatcaaaacccatatattatttagttattttcattgtctacaaggaaaataagtcaatgattttcttttatttccttattcaaaaaaattctactaaaagagctctctggcaattgcataggttcagtctctagttctaccattcagttgtggaactgtgaataggtttcttatgcttccatgtgcctcaattccctcatctatgaatggatgataaaatataatgtatacctgacagggtgcttctgaagcttaaataaattacttcacaaaaagcattgcaaattcttaatatacattatagcttattctcattgtatttttttttatggtgagcaccttgtatgtgtcatgcatttagaacaaatttgctataattcttaaaaacaagtctaataattggctaattggctgtctttaactgcctttccttttaattttcacctagcataagttttctgatttgtaatattttctggtcttcaaaaattgctcaggaaaaatgagtgcaaaatatttatgtaattaggatagttcaacattttcaaaaatggcaaaaataaacagcagttatggaacacctgcttaaaatatactggaaataactgcttcatgcttcattaaccagtataaacatgtttgccagtttaaatcccctactgaagtcagaatttccaattagtactagaagaatattaaactaccaagtgaagatattcctgggcaataatttcagaactgccattcttaaggcacttttaccggtcaaacacatgcttattttctaagaagcctatgatttacttattaaacaaaatttgtatctattttaataaacgattttagactacttattttgctagattttattcacctctgagtagcattcaatacagtgcctgaaataagatgcttcgagcaccaaagaaatagaaaaaaggaagaagaaggcagatagtaagagaggactatataatgcctcaagaaaaacttctataattgttgagtccaattataactctgttttgggtaagtgaacataagaaacatatagcctatatatagatagatatctatatatagagagagatatatgtatatatatcaatatatagatagagagacagtaatgcaggctagaaatataaaggaatcttcaatctaaagatagtattaaaagtaaggagataacgagataaccaatgtagtgactattttaaaagaaagaaagagagtttgagctctgggcactgaaatatctagggatgagaggagaaataatcaacaaagaagtgaagaaaaacaagaaggagatgtcagtgaggtaagaagaaaactttttcgtatctcatcagttactggttactggctagctagtggggataaaagttccagcatcctacttgggtctttatgaattgaaaaacaaaccatatgttttggtgacactttcattcaattatttatgccagcatgaagaggataataacaaatacgtaaggagcagcattattcaaccacaccgagaataactttcaaccctagcttcatatttcacttttgggaataaaccttactgctctgagaaattcatgaatgtcacagagagtcttcaaactaacagacatcagtgcaataaatctgatcttataaatcgagattactattttaacatagatctaaagctttcattttatttttctactaatactcattacagaagacctgaaatatacaaaagtgccaaaaaatataatcaatattaatatttcatttttttgttcttttgtgcatatatatataaaggtatggttatgtgtaagtgtacacaatcactattgaatacagtgatgttaaatcctttttccatgtaatgcagatagaatttatccagattattatttcaaaaacatcttaatgactgcacaatataccactgaattaatttactctaatttgcttaaccatgacccactggttggaattcagtgggatttcccctacatttgtctccattgagtaaataatgcctaagataatcctctttgtgcttaattctttatctatattcctaattctttccttcagatatgttattagaaaataaattactggtgcaagtgtttgataattttaaagtattgttatgaactgaactatatctcctcaaaaatcttatgttgaagtcctaacccccactatctcaaaatgtagctatatttggagagagagtctttaaagaggtaattaagttaaaatgaggttattagggtatgtcctaatccaatatagccgatgtccttatttggacacacgcacacccaaagtgaaaaactcagggagaagacaccatctacaagccaaggagagaggtcttggaagaaatcaccttgatctgggactcctaacctccagaactgtgagaaaataagtctctgttgtttaagccacctagtctgtggtatcttcttgtagcatccgtaggtataaatagcatccctaggtatagcatcacaggtccaaatgaatattgtcaaagatattgtcaaactgcttttataaatatttgggtcaatatatatttgacagagaaagtggacctcactgtaccttggttattatttttaaaatgataaaataaactcaatttataggatcacattatgagatacaaatgctaatttccataaaataacaacaacagcaatcaaaataaagaaagtctccatttcgaaataaagtcctgaccataaatactttgaaaacttataaatgcgagacattagggaagtcacatagtgtctcttgatcatagttctcagacctttaaaaattagagatttaggcttgatagtctttaagggctttctaagtttaaaaattatatcacactctggggactgttgtggggtggggggtggagggatagcattaggagatatacctaatgctaaatgacgagttaatgggtgcagcacaccagcacatggcacatgtatacatatgtaactaacctgcacattgtgcacatgtaccctaaaacttaaagtataataataataaaaaaaagaaaaaaaactataataaaaaaattatatgattcttttttcagtgttattcaattgctcttatcattaaactgcgtcatggcttgtaagtggcctattccttgaacaatctgaatcacactggtttccttttagagacctctactagaagcatcatgatagaaaacaaagctcccaaaactggaacaagaaaaactgaattcaaaatccatgtctgtaattaagtgactatgggatcttttcatgtaacattgtttctctgtttctttttcttttttcattcaaaaaaaattgcccagtggctggtgatagaaaaacttaaaattagataaatacaagcacacatgagcacacaccctcagtttccatcctcaaagagttcataatataagaaggaggaaagaagtacataaactaaaatcatacattctataagaaagtatatacacggttccaattgagctaatgttaaactaatactactgtctcactcattaatttgggaatgttaatttggggtaatctggggaaatcagataaaaagacatttctttcaaaatttaaaaacgtatataactttaagatggaatttctaacatcacctttaaggttgtacttatatccgatctatggtgtcagtttcagctctataatcacctcctatatacagttaaacaaagttctagcaataatctcagagaaatgctgttttgctcctacacctcacctggaaatattaggtgttcatagaacatctaatgttcatatattttgtgagggtgtatttttaaagtccacagataccagtgtatctatagctttcttcatttagactatatctttaacatgaaaactcttctgtatcattgtgtcattaggcaaaacaattttaaaacaaattttaaagattttgaaaaaagaaattttggcaccaaactaaatttacaggttgcatatcccttatcaaaaatgcttgacaacagatttgtttcagatttgggtattatgaattttcagatttgggttactcaacctgtatataatttgtatttcaggagattttttaaagcagtgtaattaaaaatacactttcaaactttttcaaatattaaatatttaaaatatttttaaaatcacggctgtactttaataccttatttctaagtgtatgtaaaatcttgccttacaatgtgtggagtgaggtaattttcagcatgaaatagtgtatcagtggtacttacaaagcagttcttatcaggatttcttttccaatgtttcttgtctaatttcttggccgaagtggaacgcagagttgcatgagtttgtgttcgaggatttaaagccaggatactctaaagacagcataaacaatgtgtaaatatatggaaatatgttggcatttgtttaaacttatttttattttatttttatttattttgagacacggtctctctcactttgtcacccaggctggagtgcagtggtacaatctcagttcactgcaacctctgccttccaggctcaggcgatcctcccaccttagtctcccaagtagctcggactacaggcgtacgctaccacacctggctaatttttatatttttaatagagatgaggtttcgccatgttgcccaggctggtcttgaactcctggtctcaagcgatccacctggctcaacctcccaaagtgctggggttacaggtgtgagccaccatgtctggtagcatttttaggaatcaaactttatctaagatttcctcttacaggcccctaaagaaagggttagccaggaaagaaaacttaggaatcacaaaaaaaaaaagatacatgtaaatcagaagaatgaccccaaatttgcaagattgtgtttaataaaatcaagtgaggaatcctatatttggttttccaaaaaaaagttcagtatgggaaaatcctaatacaatgaaaatttatatggaaaaagtgagaagatatacttgtcttagaaaaaatctaataatgttatcattgatataatgacatcattatatcaatgtatatcattatacattgacaaaaagctaaaatatatgtttaaaatgttgcatggctctcaaacagcttacattaatagactaatatggggcaaaatataaatcgagtaattgttattgtattttctactaattagccagaagcaattcttgaccagaagaaaaacttcaagaaaaacaaataaatataatcaataatgaacaacataccattatttcaccagagaggaggaaacatggtagtagcacatgcttctgtctaaccaaattaacattattacctaccatctttcaataatgattatgtgttgaaaagttagatgcaacagctgaagaaaagcctggagaaaagatctgggagagacacagtgtatttcagtaggtgaagaactttcacatggaagagagatttaatttgttttgtattaacacagaaccaaggctgtggaaattaatggaggaagatttggattcagatataaattaaaaagtggcagctgagattgtattagaaatcattccagctgacattactgcagtcattttaaatgatgttcatttcaaaagtcttcttccatgaagttacccctaactaatctagatccatttttctgtttcagatcactgaaacatctctaccacagtatttcagtctaaacagtaactgctgctttaagaattttcttcccttctaaactgtgaatgtgttgagttgcgggattcctgacttttcaaaaatctttcagtttatgatatacagtaccaggtaggtagcatatgcttattcctgtaaaatagtaattcaaaaatcataaatataatttttaattcctagtactcttataactttgagtaaaccattgatctttttgatctttgatttcctcacatgcaaaatagggcaacacctgaatcagaagtaaagaataaatgaaatgcatgatacaacatgttttctaaactacaaaaaccctaaaaattgaagtgtagtgaaaatggaatccagaggctatgtgcaacagtaatcctctgtccatgatttgttcatgtagtggccaagtaagaatttgaaggggacctgagaatgcaattcctactagatttaaccaaatccaagatcaccttccaaatctagattccatgattctttaaaaattattgggtcatgttcatcattttcacatataaaaatgaactcttattgagatccacagagaactatcaaaaagaccacaataaatgaacagataaaagaattattatactattaacaacagacacaagctaaaaatgttattttccacctctactaatgtaattccacaatcaacatatctaaagtaatcattttctaggtgatatcttagctgattttataagagtatcacatgctaatatgaagaatttaaaaatcataaatgactttctaaaataaatgttatacttagtattcttagacaagaataaaatcagaaaaagtcacttcatttcattctgcatttgatttaaagtggtaataacaatgctttgtgttttaagtttttagagtttaaaagttcaaaagctttcacatccattatgtaacttaacttacaaacagctactactctctcaatacttaggatgagcaaataaattgagggtgattaagtaacctgcttaagatctcacagttaatatgcaaaaagaattgaattggaactctgtttttctgagtatgggacttatattgaacctgatccaaagatgagggctatatttaaaagtcactttttgagatataaggtaggaaacatttttaaccacatgtttaaataatatcaatttgcacctgagtagctcaatgaaaaattaatttcaaaccctgtcttgagcaagccagtaaacatgaccattaagaggtcacctctggaatggtagagtaaggacctctgcagactgactcccataaaaataaacatataactgcaaaaatagtaaaaatgaaaactctttgaagtctctggaaatttgccttaaggcaaacagcaaatgaagaaacaataatacatgaaaatctgctaaaactggtaaaaggagtgaaggtctatggcatttgaagtataacccacaccacttcagtccagtgtgacagtcattctacctcagatgggtatagctcaaaacacagagctcgctctaccccagccaccagttgagggctatggtatctcccagagaggggtaagatgccagcatttctcattttctctctcccccatgctacacagagacaaaactgcaactgagtgcagctgagactaaagtgcagctgacaggtcaggagttctgttactccatccagcccccactcatagagccaaggttctacctcaggaatatcatgccaataacaccagggccctgattatccttgcctcacctcacttactgggtagagattgcacacaaggaagagcaagctgagaggactagaggctattgcctatacctagtactttgctcataaagcagaaatttaactctgagagaagtgggccattgtcactatcctcagctctggagcagtggcccagagatttttcccagaagacacaagccataagaacagagaggtccccccaaaggaactgactttatttgaacctgtatgcagggaagttcaaacctaagagtactcttataaacaataaaaatgttcatgtcaaacaattaagaagagggaggtagcttcctgaaaacaaaaaactgaaccataaggcaggtagttcataagggaaacccagggaaagaaacataagatgagttctcctggagttacaaaaaacctcaaggactcacctcaaaaactaccactgaaaaaaggcccaaatttaactgaatcacactgtggaacaactcatattccacagcaaaagtaataaagaaatcaaccagaagccactggaactaagatctgggtgtgacattactacaggcagacatcttaagagagagatcagagaaaaaggcaaagagacacctgataaaaccagggacacccaagaatgactgcacatatccaaggctgcaccctgtgagaatgacatcagcggttcacacagaggaaaatgtacatccctaaatagtatatccaggccaggcataatgggtcatgtctgtaatgccagcactttgggaggctgaggcaagtggactgcttgaggaattcaagaccagcctgggcaacacagtgaatccccatctctataaaaaatacaaaaattagccgggcatggtggcatatgcctgtggtctcagctactcagaaggctgaagcaggaggatcgcttgagcctgggaggtcaaggatgcagtgagctgtgaccatgccactttactccagcctgggtgacaaagtgagactctgcattaaaaaaaaaaaaaaaaaaaaaaaaaagtatatccagtcgctagtaacaagtcgccctcctctagagggggtttagtgtccggcaagaatagctacattatgtaagatgttcagtcttcaatttaaaaaagtatgagccatgcaaagaaacagaattgtgtgatccatacagacacacaaaaaaaggagacaacagaaactcccattaagagggcccatgtgtcaaatttaacactttgatatggtttagctgcatccccacccaaatctcatcttgaattgtagttcccataatccccatgtggtcatgggagggacccggtgggagataattgaatcatggggccagttacccccatgctgctgttctcatgatagtgagtgagttctcacgatatgtgatggttttataagtgacttttccgtctttgctaagcacttcttcctgctgtcatgtgaagaaggatgtgtttgcttccccttctgccatgattgtaagttccctcacgcctccccagacatgcacaactgtgagtcagttaaaccactttcctttataaattgcccagtctcgggcagttctttacagcagcatgagaactaatacacacttcaaagcagccattacaaggaaagtatgatgacaatgtcttagagagtacagaatatccatatacagatataaatcacttaaattattttaacaaaaacaacaagcaggcattctggtcttgaaaaatacaatagctgatatgaaacattcactagagttcaatagtagatttgaactagcagaagaaagaatcagcaaacttaaagacagatcaagagagattacacaatcagaagaccaaagagaaaaagaataaagaaaaattaacagagcctcaatgatatgtgatacaccactgagcaaaccaaaatactgtaatgggattacctgaaaaagaaaagacaaagcaggagaaaatacagaagttacactggcttaaaatttgcccgatttattttttttttaataaagtagaacaaggtatattacactataccttcaggaagctcaatgaatgtgaagtatgctaaatgtaaagagatccacacaaagaacatcagtaaaagggctgaaagtcaatagcaaaaagaaaatcttgaatgtagcaaaaaaaaaataattcatcatgtaaaaatagtttcaataagtttaacagtgaatttctcattaacaaccagagagaccagagagaagtgggataagacatacaaagtattaaaagaaaaaaaaatgtgaaccatgactcctatacccaacaaaactatctttcaaaaaatacattcccagaataacaaacaataagagaatttgttattagcagatgtgacttataagaattactaaaggaagttcttggccaggcatgatggctcccgcctgtaatcccaacactttgggagtccaaggcaggtggatcaccaaggtcaggagttcaagaccagcctggccaacatggtgaaaccctgtctctactaaaaatacaaaaattagccaggcatggtcgtgggtgcctgtaatcccagctactcagaaggctgaggcaggagaatcacttgaactccagaggtggaggttacaatgagccgagatcacgccactgcactccagcctaggcaacaagagtgaaactctgtctcaaaataaatagataaataaaaatgaaaataaaaagtgaaaaaaataaaattaaaggaagttcttcaggcagaaagtaagtaaccataacttactattcacacgaaaaaaacaaaggtcaacagtaaagtataggtaattatgaaattataatagtataaatgtatactgtcagactagataaaaagcaagatgcaactatgttctgtctttaggagacacactttaaattcaatgacacaaatatgttgaaagtaaaagatggaaaatgacatatcatgcaaatagcagcagcatgaaagctgcagtgcccatactaatatcagaacaacaaacttttaaagaaacaaaaaaatttactagaaataaagaggaacattttatcatcataaaggctcaatctaccaggaaaatataacaattataaacatatatgtgcctaacaacaaggcccaaaatacaaacaaatttgaaaggaaacaaatctttaaacaatactaattaaagacttcaatactccacattaaacagtggatagaacaactaggcagaagaccaaaaaggaaacagaagacttgaataacaactataaatcaacaagacctaacagacatccatataacactctaaaagagcaaaatacacattcttctcaactctatatggaatcttctctaggatatattgtatgctagatgaaaaaacaacttctactaacttaaaaatattaaatcatacaaaatagttctccctcttcaatggaatagaattagatatcaataacagaaagaaatttggaaaattcaaaaacaatatgatgaatactgtaaacattatgctaagtgaaagatgtcaactacaaatatgacatattgttgataccatttatataaaatgtccagaataagcaaatctatagagataaaaagtatattagtggttgctcaggctggcggattagggagaaatgagatggctactataaaaaggataagtgatttctttttgggtgaagaaacctgattatggttatattggcacaactctgaatacactaaaaaatactttgaattctataatttacattggttaattgttgatttgtgaactgtatatcaataaagctgttaccaaagtaaaaccctattaaattctacattcagtcgatttagccatatactttattcactgtaataccactaaaacttcctttattagctcaatataaatgtaacaagattatttttagtaactcctaaatattacagaaatcatatttcttcagtctctcaagttagacatctgtgtctttttgaagaaaaatatacaataaagctttaattttaagtggtgtattccttatgatgaaataatactaacaggacctattttacaaagccagtattagaagattcaagtaatctcatgcttatagaaaaaaagtgaaaacattttcttattccagaatataatgtttgcttatctattcagttttcaaccattactaatctcatccattaattcaaattgagaaataaaaagacacatttttttaaagtagttattctaacatttaaagcaaaccagccaggtaacatgcaagaaagatggctgcatttattttagtttttatttccataatccatattgtgataaatgatcatgtttatctatgtcagcatagcaatataacttttgagaataaacattctgaatgtaatttattggctacttatcacagctacttttctttcacatagcataagtagaaagcataacataacatgaaatattgggttaaccttttgcaaaaaggcagtgagttgaattcaatggatcttgggtaaaaataaattggattgtgcaaaatggttaccaaggatttggcttaataatatcccaaatgaaatgtgatataaaataaaaatacaagacatgagtggttcagagctgttaaaaataattttccaaagcaagactttaaaaaactaaaagtcaatatcatcaataactaagcagctgacagataatacaggagagttctaaattgcatttttcctaagaaatggccaaaggcacgttccaacaggtcacagagtcccctctctggatgaattgagcactttaagaagcccattaaccctttcagatacagggtacattacttatacagggagatttttctctcatcaaagaatttgacttgtttggctttaccaaacattttcagtaacacaataaagatacactggttattccagacgcagaaaaaaaaattagaaaaaatttaattgtactaattttacctagtttaagaaatgatggaatattatccagggccaagtataaatgaaatcaaataagagttatatattgtcaccgtttggtctgttaacactattctgtgaagcagtggaatgcggaaacatacaaactagaattatacatctaaagagagtttttctgtattaccattgagggcaaaaaagagaagcctgtattgattacaatcacaggccctcatgtcacaaacaaaatcactaaatcttaggcctaaaacattggagcttcagtattattcaagagcttgaattccaattgcaggaagctacttgaccaacatgtcctctttcttaacatgtggtattgttttatatcacaatagtaattatccaaacatagtgtaccattaagcttcctttaccctttgcattcgaacttataaacaaatttttcctattcaatactggtaattacttgctataattctgagccattaaaatgatacacatgttgctgacattttgtacttacatgcttaagatgataaactaagttttgtcttatttaaattatgcttacatttttctttaatggcttattctgagttctctataagttatctcctactttccaatgcatcaagtaaacaaataataataataataaacatgtttttcccatttctttcataattggacagaaatactttgatttcaatataacattgtgctgtggtgccaattttttatcaataaatattctcagctaacagaaaaacagaaatatctattgattaatgcttttgacgagtatttgttgccttatccaggtaacaatctaactaaggctggtcagtggagaactaaatttttcagtttatttgcttaacagtctcttgtttaaaagccccagtctcagccagttatcccacgcttctccatgtctctcattagtcatagtgtagagtgatttaattaatatctcagaaattcacaaaggtatctttggttcttgaataagctcagaactgatacggcccatctcctgctaggtagggaacagaagaggagagaatgcagctttattttgcatcctaggttcacacttgagatacaatcaaccttagagtctgaaaatttcagaaacccatggtaatcagtcctggtcaaagacttacatttacctaataattttttaaatgtacttccattctttgcccagacacaggtttctaagcccctaggttgttctacttttccaagtaacttatcatactttttttcccattttactagctctgtacaaaggccaattttccctttatgcacagtgggtaactcactgcagttgattaaaaatttatgaaggaaagaatctctgatagtcctaaatcttacaactttcattttgttaagtattcactaagcaatatgcatagtgtttgagattaaatttgggtttctatcttagctctactattcttgttggttatttaaactctcaagctctctactccttcaactgtaaaatggtgattagtaatagtacttaccccatagggttgttgtgatgattaaataagataatgcaaaagatgtttagagtggtgcatgcagtaagtgcttaccacatgttatctatgtatgtaatagaactaggttttagccactattaacccaatgtatactcatattcctatattgtcaattctgaatgtatacatgggaatcatatttttaagtacaggaatatagaaaaaggatgaagacaacaggtgagaaaatatctataaataaggtagtacaaaaaatagagatgtatctcagaggaaaccaaatcactgactgagtcatgggtctctgaacttatcattgccctaagccctgcaatttcaaaggcagactgcctgaaaatacaatatgctttttgcaaattaatatggcagtgtggaagggtcatgaaattcaaaaacagattttaatatccatcgcatatatatatatatatatatatatatatatatagcaatggagatatcattttataatccatagaactgtatataactcatgggtctttggtcccaacatgtttaggtaaatttacattacatttccttcccaggaagggcatgtcagatgaaaaatgatgaatttgtaaaacatcaaaaaatgttatcaactgaaaataaatgaatcccttcagaatgctcatcatatcgcctggaatatttgattcatttctactgagcatatagttaacacaaatagtttacacattttaaaatatcatgtctattatgtcactctcacactcaacaaggtaaggtgagccagaggaagctcttcgtctgtctttgcaaggcccagtgtgtgactctccttcacttctaaaatacacaccacacaacaggtgcctaaatgatctctatgtgaaaaaaaaagtctttttattgtctttcagaaaagattgacaattcaaacacaagaataataacatctgatattaacctcacaattcttaatacagaacagagcatgccaaaggtagtgactaattctgacatagacaatttagtctgttcaggcttttataacagaattccataagctgggtggcttaaacaacagatctttatttctcacagttagagaggctggaaagtctaagatcaaggtgcctgacaatttggttccaggtaagaatccttttccctcttctgactcactcacagccacctttttgcagtgtgatcatgttgcagagagagaggatgagaatgagagaaagctctctgtagtcttttcttataagaagcactaatcccactatgagggtcccaccctcatgacctcatctacccctagctaccttctaaaggctccatcttcaaataccacacattggaagttaagtcttcaacatatgaattttgaggggacataaacagttcataacagacaaggaaaggattccaccacctgtggaagtatgcaaatactattaatattgggcatcaacttaaagtcacctttagcctaagagttcaaatggtaccatgttgactgtaccattttattttatcaagaagaaacttcagaataaccaaaggagatattttaaagtattgcttaatttaagaaaagaaaagaaaacaatattaccaaataatgtaacactagctattaattatatatctttattctttaaacaatttaaacagcaaaacattaataacatatatactttatatatactgtttgtatatttttattataggaattgagaaataaagtgtcaaatgcaaacacttataaagagatatcaaaaatatataaaatgggataacctatactgtactttattttaaaatttcattactttaattataaactattttcaatttaatataatgtggcaaagcatccatatattacatatttaaattaaaaccagtatgtagaaaatgtgtaactatgaaaatacacgttggaatatcttgcatttgcaaaaagttgaacatatgtataaatttatacaaaatcccaagacagaattatgtgaaaagaaagttgatagggattattacgttaccaaaaaaattcaccagttcattgggtaagaaaatctatattttagcatttatactttttttcattcaaaacaaattagtcaatttacctcaaaacttgctttacagaaattgcctggctcctatgtaaaattggccttagagggcctttttcaagtagtatgaaaagtattatgatttacctttaatctagtaccttttgtgtataaaatactctcatttacaaaagacactgctcacaagaccaagggttattttagttcaaaagaggctaagtgtataccagcatgctaaaattatttaataccagtcaacaaatagagatgctggaaaacaggacttcaagggaaagatgaaagcaggacctgggctaactgagtttaaatgttttacaaattaagtaaatagaggaagtagcatgattttcaggttcacaaaactgtaataaatcatagcgtgactagttgcccttcatctatatggttaacagctaaaaggaaatatatatatgggctggcaagtgacttatgttaaaaataagaactgatatgataaaaatgagttttcatttctggattttattaattgaaggattatcatatctattttttgagaaggatcagagtagagcaaggagctgaggagttggggaattgggtgagttgaggagttggactatttaaaatcatgaaatttatgaatttaaagttcatgcatacaattactatttaagctacttttatttccttaataagtaatattttgtattcttaattaatacactttgtttcaatgcctagagagaatgctttccatttaaacagtagtattagctgtatatgcagtatggagtcacatcaagatatcccaatttttttaccaaaaacaacctaggaattccaatttaagagaacaaatatctcacttaaaataatttaagtttatacctaaagcaagatataaaaatataacacccaatcttacactgtaattacatactatttgacctaatctagcttctttccagggattaataaaattaacttggcatcttttttgggtccctaggatttagtatattagagttggaatggactcttagagattaacatttgatttcacgtcctatttagaaatcctgttccaaacactcattgaactatatcaatcaaattaatcaaaaatgacatagtgttagtctcttatataaagctcacataaatggataagaaaacaggaaaatattatcagataagctggaaaagggcatgaacagatcacagaagaatgcatacatatctccaatttaaagtgaaaaagagaaacattcagctacccactgagtcttcactttcctaccactactgcaaatgctcttgtcaagtctcaccgatgatgtgcatgttacccaacattctttgtgcattgttaggttttacttctccccgtctcatatttaagtgactttatttttttcttcataggtaaagtattacttttttacaatagctttattgagatataattcacttacacatgattcacctattttaagtatataattcatgaattttagtatacctacaaagctgtgcaaccatcaccatagtcaattttaaaacatttcatcaaacatatccctgccaaaaacatgtacccattatcagtcacttccagttttccccaaacctccagatttaagcaccattaatctactttctaactctttggatttgtctgttttggacatgtcatataaatggaatcatacaatatgttgtttttttgtaaatggtttctttcacttagcataatgtcttcaaagattattcatatagcattttacttgtatatgtgttataaaccccatactttactgtttaatttaaatgaccaattctcttaatgaggtttaaatagtaagtaaaaatcatatatctacctatgtagttaccatttttgcaattatgtaatccttggtgcaaacccctatttttacctactattgtttccttttgcctgaaggatgtgatttcctttaatatttcttgtaatgcgggtctgctgcttataaatgtttgcaacttttgtatgcctgaaaaagtctctactttgccctggtttttgaactctaatttcactggataatagaattctacactgaaagtttttgttccctgatactttaaatgtcttctcacttgcattatttccaacaataaatctgctattgctttatctttgttcttctgtatccagtacacctgtttttttcctctagccgctctgaagataaactctttatcactagttttgaccaatttgattatgatgtgcctcggcgttgttttctttatatttcttctgcttaggtttcactgggcttcttggatttacaaattcatttttacaaatattttcttcttctctcctcccactgcttcactctcatctctggggaaattccatttacatgtatatgaggccactcgaagttgttccacagctcactgatagtcttttcatttttttctctctctgtgtttcattttagagtttttattgctatgtcctcaagttaactatcttttcttctgcagtgtctaatctgtcttcaatattatccagtgtgtttttcatctccttacagttgccatctttagaagttcaatttgggtctcctatctattttgcacacctctacttcattttttgaacatatagaatacagttataatgacagttttaatgttcttctctgctaatttaacatctgtgtcggctttggatttgtctcaatacattaatttttatcctcattatgggtggtattttcctgcatcctttcatgcctagttatttttaattggatgatagacattgtgaattttaccatattgggtacatgatattttcgcattcctataaatgtttttgagttttgttctaggacataattgaattatttgaaaatgatttgatcctctcaggtcttggttttaagctttgtgaggagggaatcaagcagcatttgctctggggctaattatttcccactactgaggcaaaaaacttctgaatacccaatgtcgtatgaatcatgaagttttccagtctggctggtgggaggaggcattattcccagacccatgtgagtgctagttccgtcggactgttctttacgcagccatgggtcattttcccacatgcgtatactaatcattactctgtggagtactcaaggggaaccctctgctgatctgcaggtttctctctgagcagctctagcctctctgttgttctgttctacaaactctagcttccttggtctccctagactttcagctctgtctctccaattgaaggattccaccaggctttgtgtggtttcccccttctgatctgcagcctataaactctctcaagaggataaactagaaaaatattagggtttccttcatttgtttatgtttctcagggaacactgtatttcattgcttgatagccagtatcttaaaaataattgtttcatatattttgtttcttttttattgtttcaggtggaaatgtgtacaggaaagaacctgataggcctgagttgctcaaatcctgagcaatatggtttgactgtgtccccaaccaaacccaccttgaactgtaataatccccatgtcacacgggtggggctaggtgaaggtaactgaatcatcagggaggtttccccacactgttttcatggtagtgaatacgtctcatgagatctgatggttttctacatggtggttcctctgcataagctttcttgcctgccaccatgtaagatgtgcctttgctcctcctttgccttccaacatgattgtgaagccaccccagccatgtggaactctgaatccatcaaacctctttcctttataaattatccagtttcaggtatgtcttaatcagcagcgtgagaacagactaatacactaagcattcccaagaaaggcttgttttcagaagaagtggccctcagctcactcctaggaaccaagctgtgactattctgtcagacaagagtgttttgttttgtttttttttttaatgccaaaggccttgggccacgttgtaacagttggctagtttacattaacagtgtgattaatgatgagtatctgctttttctctggtggtctgaaccttgaataactgaagtcagtcacacagcactatatgtatacatgactaacacgcaattaaaaaccctggatactaaggtttgggtgagcttcccttattggcaactcttcacatgttgtcacacatcatttgctggaagaattaaatgtgtgccatgtaactccattgggagaggacaactgaaagcttgtgggtgacttcctctgaactttgacaaatgcgccttttccctttgtttcttttaatttattctttcaccataataaactataaccatgaatacaacaacttctatatcctgagggtatttatagtaaatcaattgtgcctggaggtggtcttggaacccccaatacaaaatgtacatctattccctagtgtcccaccttgagtgtatgcagaattccagtaagagtatcatactctagtggccactccttcacatggcttaattttatagagcacctggacaaacaatacagaaaaattttcaaaatggcaatacgtaatttctttactcacttttatataggaatcttaggtaaatgtattagagattgatacgtggtcatgggaccatgggctttaaagtagaaaaagttaacttatcacagatactcctgaataaatcagctgcatcagaatatctcagatttccctacacatctatcaattatacatggataggccttgggaatcaatcagtttaacaaatgtctgtggcagactttgcagctctcctgcctcagtatgcactccatccttccttcttagtagcaaacccctattacattttgggagccatagttctcagctacagactataattcccaggctttgacaagccattcagctaagtaccaggaaataatatgcatttagaagtgtgtatcttttaaggagtctcattaaagggagaggtataccttgtttttcctgttcttctctgcttttggagctctagctgctaacttcaacagagaggtgaacttgaggatatcagaatggaaagacagaaacctgttgacaacaaaaaggtgctatacgcactctagtatctatctctggacttcttttacatgaggaataaataaagttctgtcttctttaagccgcttttagcaatttttcccatgttataccccaacacctggtttttacagtgcccaaggtgattctggtggtcaactaggtatgggaaggactgatagtccaatcaacaaggcaaaatattcaaaaccagggtgcatggaaacttcaaaataaaagcatttggcttatgtacttaaaagataagtgggaaatcacatcagcttaagtatttttcttgaaatccatcaaatgtcaaaaatcctaaaccaaaacttactcatttcaaagaatgatcaatggaaattttattgtgccagcacaaaaaaagtaattcattttcatctccattcattgactgctaataggtttctccattttaactgacataatttttttacaatatagcataatgatgtgaataaaatatatccaatgctcctttgcaaactgttttttgaaaatctcccatgcacacaactccctccccaaaatccacacttccaaccagtctgttaaatccctccctcctatcaagccgcagtagataacacatttctgtgctcccaagatacaccatgcaaaacaccctatctctattaatattctaacttgatttctggatgtgttctcagtctaatatatacttcaacaataagacagtttagcaactttttatcaaaattttataatgtcttttattcgaaaaaaattatattaaaaaatgatataagaacattttttaatgttcttatatcagatgactatttggtaatacctgatgttgaatgagagcttacagtatgccaggcaccccttcaagtgtttttcaagtacagatgagaaaactaaatcacaaggagattgagtaacttccccaggaagtaacagagattcttaacccacatattttggcttcagattatggactgttattcactactctgtacttcttctatgggcagctaatattagtttcattttaatgtagtaactcaacgattgctgcatattcactgtaaatactgaaatcaattttgcgctggtgcagctacagaaacaagacctgaaataagtcagattaaagaaaagtctattatatgctgattaagccacaatatataccaaacttcctggtacacattgcttatatagtgttacttcaaatgaaaagaaagagacaaacctcagaaatattgttaaggaagctctagcaggacttgataacaatgagtataggttgtaaagagacagaaaagtaaatacacctcccatattaacaatttgtgattataaggggaatagtatgcacagaaaataaaagttgggatagaaaactggcttagaaaaaaatatttagtactgtttggctcatcacttgaataatggtgtcatcttacaaatgacatataagcagcaacaataacaaaaaactgacagtgaaatacagcatgtctccagtgcctttcaattaattgttggatttgaattaagttcacacatcttgtctaaaaagctaagatttttctttaattgtaaaaaaatcacagatgctctggtatcaaaaatacatttaccattcagaaatgtcaggtaatgctacttccattaaaatagaaattctgggtttaatatttatcaatttataaaatagtttacatatattattaaaccctcaaattcttgtattccaattgaaatccacatagtctaaaattctctgcttatatgcctgtctgccccactagcctttcagcttactgagtatgatgactggctattacccttctcagtatctccaggaacttatataaggcataaatatagagacttgcaataaattgaattgtatctccttagagtgtaagagccacaagggacctctatttacagatgcgcctagtgaagtaaaagaacaatccatattaaagactgagtcaagattagaaccaagtctcctaactctatgacatcaccacactcatacaaaaatatcactacaatgaggctcctgaatactttgaattatccatgactttacattgcctacgagcctacttctgataagaaaccatacttgaaagtagcataagagcaagaattagaagatgcataaataatatagaccagagaggcataagaggtcagaagttcagtgttttggatttactgggtaaaactggttttctttaatttccataggaaagattacaggatgcccacatgtcaagtaattctttaatcattaagtttgctgtttccattgaaatgttattcatctcaaagatatgtaaattatcaccatcactttaatacaatgcttcctacactttctctgtcattttaaagattaagactgaaaataaattaaaagcaggggtatgttgctatataataagaggtaatttcatcaaattagtaacattcagattctaatgagatttctttattattttagacacagaatattttcctaaaggagcatactaaacaaaacaatctaccttttaagacttttcttaaatggagcataccactagaaaacaaacagctattatttttcatttcaatctaaataactgcaataacttccaggtgtttagaaagaggtacctcccaacactacatagttccacgctttctttaaaccttcctaacacttagacttactcaaagatataaacattattccaaaggatgataaatattgcatcgtaattaaggttactgggctggcacagaagagaatttgacttaatgggagacttctgtgatggaaattaataagtttgccacttaattacaaacagtgtgggttgtgagcaacattcatactatttacacacttgttaagatttaagtaagaaaaggcttgataatacatctcttatttactacgaagcaaaattaaaacttgaaaactagaaacaatctatatttaacaatatcacaaagaatgaaatagctccgatttcttttgctttaaaatttgttttactgaatataatacatatttatttttaaaagttttaatccgaatgaatgataaccccctaaaatgcaggttatagagctggatgaagcatgtgaaaatttttagaaacgtatgtaaatggtgtttctcacaatttatggatcagttctgtctatcaattccaaatttgagtttttgtcataaccagaatcttgaaatggtcaaaacatgttggtctagcaaatcaatatctaacatggacaacgctaagtaaatgtccttggttattaagttaattatatattaacatataagtatgtttaatatcaacagtatctttttaaaactattccttagaaaatctttcttgatactgtcttacaattcatcttttttcacattcaggcccattgtttggtaattttaaattacttcaaactatactagaggaactaagaaatccaaatatctagagttttaaaatgttaattcaaactttaggcagccttttaaaaagctgcctttccaagactgctaggcaaatggccaacaacaacattttaactgtccaaaaatctgacggctgaataaaaatttgaattttactagcaaatgaattaagagaaacagctaaagtgttgcttctagaaagggaaataggagaagatggagaggggtgaggtgaaagctagacccagtgggcactggagagaggatagctaacatctatttccaactccctattcttagggagggcttaaaatcagcaacagaggctgtatttaccccagggtaatcaggaagggctacacatcaggatgtcccttctctgcaccatccctcccctaactcccatttactagtttaccatcatatcactgggaggaatagaaccactattccacaaagttgtttgtttatttttaaatgtttatgatatgcatgtactatcatgatggaaatcaaacacatttaaagatgtcattattaaaacaatggaataattcagaaatgattatacaggatccactgggtggcaaggtaatcataacatttcagtgacaatatcttaatcataatggaagtgtgggagaccagaatataccttcccaaaatatgaagggttattgcactgaaggcagttaagaagaaacacaggagagttctctggcctccctttatttgcctaaaagcagtagatagatttacaaagaaaatggtatcctgcccacctctctaccaaaaagaaaaaaggttaaccaccaaagacagctttagacccttatcagcctagcaacagtaccagaggaatttatattaacaagttttactaacttttgtctgccatgcatttgccttctcctcaagttgccatcctttgtcttttcagttctctaaaaatgtactgttctttgttgaaggagctatttcaaaaccacttctgggaaaactactcattctctgggtatctcccatgtacttgtgaaatatatatgttaatcagcttgtttacttttctcttgttaatccatctttcataataggggtatgttccaactaagaacctactgaaagttattactcccttacagtttgtactcaaaattccatatcaatccaaatcagttgccatgggtattaaaaggcactactgatcttgagtaatagcaagggcacctgcatagtcaatgtaatctaatttctccaggaaagttgacttacacaattaaagttaccaaacctaaaattatatttattttaagcccaatatatgtttttatggaagtatactattttagaattgataaaataaagaatttcatagattctggatttatttcactttcagattaactgagaactagactagaattgctttgttttgaacactgtagtgcaaattataattacccaatatgcacctctaactatttgctcctgtagcataattaattcaaaattatacaggactaaagatgcaaagggagcaagggttagactaatataaaattaaccttagatcatatccttgtcattatattttttcagtcctcaatatgaactggttttcttgacaatgacatcattatcattataaagtagaaataaaaagaaaaatgtccttcagtcaagggctccagtgaatcagttttataacacatctaaatgtatacagactttaaagaaaagaaaacacgatatagaatcccaaaaccaattccagtccggtaatccagtttgcctatttctttttccaaatttcccaacaaataaagattctgtcctgtcagctgccaaagtggccggcaaaggacaaaactggtcatttgacatgatgtagagaagtgattgatgatatctcatcagctccctccactgcaaccatctggcctgtggattagacgccattcataccttgcttcatttacacatgtgaaggactccttgaagaaccgaatattaaacatcttattgagaaactcagtgaatacatacggtcaggaaaaatgaggtaacttttgaaggacttcccacttctatacctctatgattcctaattttcatgtcatgtattttaatgtctgaataaacagcaatgtaaaactgagctcatattcatagattttagtttccagttcactactgactttaatcaaaccatttaacctttctatgtccttggtttcaccatttctgaaacggatacatctttttaagactggaaacatgttcttaagtagggaacaagaaaaaaaaatgctctgagtgcatagatccatgatgatccctattaattctaactctgccagctcctatacttacacctgcctcacacctgacccatttcagccaggacagccttccttcacctgtccttggaaaatgatcacctaattcattttctggcccctaaattactggatattgaggtgaaggtgaagggaaactgtaacaaaacttatatgaatttctttatcatttattaaatataatctaaataatggtgtaaaactaaattattaagttgcatgaatgtgaatttataacatgcttattttaactcttacaccataattctgaaccatcatccccaagtacttatgactttctgtcttgatatataattattggtgaaattgcctcatcttctgttctgtatcaaaagcacatttagaggagatgcatttatctttctaaccagactctaagtggtacttaatatagttcccaagatacagcaagtacttaaaaattacttataaaattgaactatggaataatatgttttgttggtaacttaagctttcgaaaaatgtatacaggagtccaccctaatccacggggatatgttccaagactcccccagtggatgtctgaaactgcagatagtattgaaccctacatatatatttgttttcaatgctttttccgttgtaactgagcacttctcatgaactgtaacttttacagcctgtggtgcaactgcaaaacttgcaagaatttctttttccttcttcacagcttcagggacagaagattcattcttaccatagatcttagcaatctcagtatctttccttaagtaaagaattttcacattttcacttgaggaagcactttactgcttctctttggcatatatgaattgtctccatcactactgttgcactctagagccattattaagtaaaatatgcgtttcttgaatacaaaggactccaatattgccacagtcatctgagaactagcatggttactaagtgactagcaggcagggagcttagaaagtgtggagaccctggctggacaaagcgatgagtcatgggctgggcaggaaggagcggaacaatgaaagatttcatcacattacccaaaatcgtgcaatttaaaacttatgaattatttatttctggaatttcacatttaatattttcagacctaaaactacaaaaagcaaaaattggatgaaggggaactgctgtgtttaatttttagtgtgggttttaaaaaattatctacctggttcttttccatatttgataacaaacatcttttcccttcatataaggactgtgcatatctggaagttaagcaacttcatgatagtaacagcttacatttgcatttgttcttaacttatttcttccaaacaacaacattataagataagcagaacaaggatcacgatctcgattttatagatggggaaattagcttaagttcacaaagctcaaaagtgccagaaccaggactttaatagcatatttaggattcttcatatttaggaatagtcaaccccaattacttccttcaactacaaaaatttgaatttaataaatactgtctcttacaaatgttagttatccccagtctcatttattcctaatatcaaagtatctgaggtcctcccctgcttcctcctccctcccttccttacgttctttgtccttcctctttccttccttcctttcttccttccacaaatatcccagctcctttgcagttcacatcaaaatttgtattcattttcttgggctgccattaaaaaaattacacaaacttagtggcttaaaacagaaatttactgcctcactcattctcaagtctagaagtctaaagtaaaggtgtcaaccttgtcatattccctctgaaatctgtaggggagaattctttgttgtctcttctaggttctggcaatccttgttatcctctggctggttgatgcatcactccaatcactgtctgcatagtcataaggctatcttttcatttttttcccctttctttttggagacaaggcgtcactctgttgcccaagctggagtgcagtggtgtaatcatggcttactgcagcttccatctctcaggctcaagcaatcctcccgcctcagcctcccaagtagctaggattacaggcacacaccagcacaccaatctaattttggtatgtgttgtagagatggggttttgccctattgcccgggctggtcttgaactcctgagttcaaacaatccacaccacttggcctcccaaagtgctgggattacaggcgtaagtcatcgtacctggcctggctgtcctttcttatgtatcttcccatcatatttcctctgtgttctactccctataactcagtgcttctgtcatctaccaaccccagggggttgccaccacaccctctacccagattcagtgagaatttaacatctaattctctatgtcttcaactccactcaattttttacaccagtcttagtgacttcaacagactcttggctcatttagcatctgcctctttttactcaccatctcaccaccaataattcttgttcttccaccccactgcagccaccatcacccttggttatagtcttgactttaccatgattatcgcactatctctaaaagctttatttcaaacataccactccaatctttacctctgacaacattccactttccaagaattatctgaccttcctgaaaccatcaatccatggagcgtatcactggtgttttcagtagtcatctcattctcctatgctgacgtccctcagatcagcttccatgatacactattatgacttcttcacaacatccttaattccctactcttctctcactccaactttattgcccaagcaaaactaatccacttaaacttatctctttacatcttatttgcctgaacccaagcagttaaaagtggatggagaacaatccactattatgttcactgctctcatgttcaattcttgactgcaagcatcaagtagaaaataaatactgcctaacaatcctactatacttattattttcattatcctactttacagaaaatctattcatactttcacctgttcttcaaacttttacagcctgttttcctctcaccctcagttggtaatcctgcctcatactcttattgagaaaattaaaaccatccattggaagagggaacttattttttgttccgccacccaatgtgccacctctgtctcaccacctattctaaaccttatattatcaatcctattccctctcaccaaaagaatccctttatacaagtaattatcctgtctatgtctttcaactctagtttccccactgcaactcttcccttaatatatgtacctgctctgttatccctctccagctacttccctattttctgttcccctttacaggaaaacttttctccagcatttcccaatgccattgtcttacttcctcacattctattttcttctcaaaccatttttattaggcttctttccccaatggctattgtcaagctcacactttttcaatgttactaagttaaaagaaatctttatgccctcaactaccctcccaacagcagacaagaaagttgactatatacacatccttcctcctcccttggtttcttggctatcttctcctcttcttaatgcctaaagtcctcagtcccttgttgagctacgctgtctttaagtaatcttactcagtcccaagactttaaataacatctttatgtcaataattcctcaatttctatctccagctacggcttctttacagacatccaaaagtttactttcagctgcctacgtggtatctttactgtgctatctaatagtgatttcaaactgaatgccattacatattaaatttgtgttccccacacctcttactttttttgtttaccaaagttcagtcccacctctttgatttgctttcatttttcctcaaaagcccctagcagacttcttatgatcttctagatttcagttcaaatgtcacctctacagggaggccttctctgactaccatgtgaaaaaagaccctactagccattctgcatcacattttcttggtttatttttacaaaagctcatgatattatctgaaattactgtatattaaagaaattttttttactattgttcctccattagaatgcaattttattgactgcagaattcttttctgtcttgtttgaaaatgtgtttacaacatctagaccagtgcttagcacattaggaaaaaattaatattttagatttaaaaaaagagagtaaattcctgtgttttaaagaagactaaaataacatattgtcaaagagataaatcactgaagtcaaacaataggtggtagccattattaataatttaatacctaatattaattgcatacttgccacatgctggaactattaaaaaggatgaatctgtagtattttcttcaaccacacaacaatcctgtaatgtaagtatgatttctatccccacttttacaatgagaaaactgaaacaaaaaatgtttaagttatttgccaaggtcaaaactagtaagtggcagagctaggctgtgaacattagcactctaattccagagtctatactcttaaccacaaatctatgctgtccttccactacaatcagactaaatattaattatctgttactcatcatcaataaatattataaaggacagaggttatcagtctactgctgtttctgaatttatctgaggtttggggagattttatgtttccaagataacattcattttgttgtgatctcatgatacattagcatctagttttcttaaaatctgttatacttctacttttcttatttgtattcttatttacatttttttattttactcttacattaaaatgttgttaaaataatttgtttaaaataaaacccaaaatattttaaaatgtggaaaaatgtttaaaatttaccaatattcaaacaaatacaaattaaacgaatcacacaaaagtttcacctaattgtttatttaaaaaataatttttattaacacttgaaagggtatcattttatacatactcatacagctgctagcagctatattaattagtagtactatgtagacatcaacttgaaaatatttcaaatccttaaagtagtcatacctaccattgatgattcccttctaggatcctataatattgtgatcttaagcataaaggatgcttaagttttgtttcttactgtccagtcttggaatgaaaggggtgatgggcactaattttcatgagctacatacaaatttttctctgcaaatgtttttatctctttcagaaaagacagagccttaagcataccaatgtctggagtctgggttgcaagtaaactttagctttaaaatgtagcaaaaatcaagagtcattttggttggcacacccaaggaagaagtatgttttgcttcatttaatttgtatgtgggagaaaaatgtgttgagtcaaaagtagttacactcacggaccctttcttctctgagtaccaggaagaaaaaaaaaagaaaatgtacacacacatgctagtgcatatgcacatgcacacacatgacaacccatacttcaaagtaaaggcaggctaggataaaataattctttgagaatctggtctgccagagtggtttgttcttggggtgagggtgagaaggctgggataatataaaagtttccatcacataatgagacagctgcagttagtattacatttactcattctagataacaacctgagatttatccattcacgacaataatctgaggtttatgaatgttccatccaagataacaacctgaggtccaaccttactcttccttttctcccagggcagaaaaaattaggaaccatgcacgctgtcaagccattctccagaaagaaacgctattatcagcactgagttaaaaggaagtcacatccacatcaaagggaactacatccagatgcctgcccgttctgttacctagaatcagtgttaggaagatgaggcaaacggttaaactggttccatttccattttgctccttctgtctttgcaccccaaaatggtccccttttccttttttaaaacatatttttaaagacacttaattcagttgaagcatgcaaacgagaacggcagaaccaaaatgcactatatatcattgagccaacactctcaagtgtatttccagcacaatgctttaagcaaataaaaaaaaattgtgctgaaacattgttcttaataactgactactaaaaaacaaggtaaatgtatgataataagagagaggcttgaatacattttgatatctccactcacaaggaatgttacgccgtgacttaaaactgaagttaatatgaatataaagaaatgcttttgataggacaagaaaacaaatatcaaattatatatgactaaaagtatttagggaaagattacctcgtgcacaggaaagaaatgtactacatcaatattacgtggatgacttgagtgggatgactatgtatctttggggtcatcttttgattttagttttttgtatgttttaaatcttctgtaataatcatgaaaaataatttaaaaatcaaatcggggaaataaagcataataaaagttaacacttttattacactaaggttacactaaaagttaacaggaatgaacattttgtggtgaacggtaacacacgttacccctagagatctgtaaggggaactgaatgcctttcttctttgaactgtggagaagtttaaatttttaccccagcactcctcaatatttggcatagagaaatatctgaaagaagtcccgcaaagctctcaggtcactgtggtacaaggagtcagattagtatagcttgaattctggggaccccattgcttatgccatggttttcacctacaatcatcaatcaacaaacacactgaagaaattggcataaagagtcccatctcctttttcgaatctctggtcttaatttctagttaaagacagcataatcctaaacatacaaaatgtaaatttgttaattccagatcacccttacacagaactccagccatatatagtacgattgaacttttcttgtattctcaggcgaaatttagatttagctacttcatcagattaaaaaagaaaaggcagcaagcagacattaaaaaagtttaaaatcaggtgaataagcacatgaaattcatacagctggtataaatagtacactcaatcctaccaagtatgtaaatcgaggagccaatatctcagcatttccttaatatgaacacacaccaggtcacatttccaaacaatttcaccattgccatattttatttcaaaccatccttaaaagactgatcaacagcaaactcactgaagatcagaaaactcttcacagtggctgaatgattcccacaaggtcagagagcaagggatctatggcatagagcaaaattatccccaggcttatcctgtatcttgggaaatgtacttattttaattaacaaatagtaaatacacattctactattttgctggcaattttcacacgaccttttcattaggcatggtaatgtttctataaattttaacatgctacaatttttcatgtcagtcttaaagaatttcataaagattaagatctaccgggtgagtcaattctgtgtaggtacactgagttgtaagttggaggataaagttttgggagagaagtaaaagtgctgggggctttgaggggttgaggtggaggagaaccagcagagagaggtgaggaataaaacatgggggggaggaggaagtgcagtcagggctccatccatgatcgcctcctatataaatcaggcctggagttgacatgtaattttgtgtgggtcccctgagaagtggccctcagggattaattattgatgaagagatttttcttcaaagtggctcagtcaagagtgcctcaaggggacattcataagtgcttataatatcaatttccaagcacctgggaggtagggacacagattgtctctttaattattatgatggaggtaaagtctagcaaaaatgctgttacacagccaaggtaaaattctcaaagaaatgaaattattatagctagtataaaaagtgtaatatatgagtcatctctcagtaagatcacactttaccttttcctggtgcaaaataggttatctccaaccaactgtttcctaggagctaaaagagttattcataagcaaatgcagtgtgtttagggatgcttaaaagtttagaaaaaaattgtttttgaagctaatatgtttgcttagaaagaagatgagtttactccagttagcacatggaaatacaagggtttgttttaattatgtaggaatttcttttcagaaaaaaattaatgtcaaatgccttctacatttctatgagaatgccaaaaaataattttcacctatgcattagccctgatctagtctcaaaaacactcagaaaaacacagaagaatcaatccatatgtatgttgcagtaaaaaaaggatggggctagcctggatttgaatcttattaacctacgtaatagatgtgaatagtcatgtataaacaaaacctaggccatatacttcctttgtaccatctgaaacttacaccagtgggctcgcagtacaacaggtactaaaaacatatttttagacagaaatgaaatgaaatgggtctctttaaattgatctgaatttcagaaactccccaatctccctcataatattgacaaatgttaattcagtaactttttcacaatagatatatgcaacatttataaatctataatgcacctctttcataatcttttaacttcattaactcctccctttctcatagattctaacagacttcaataccactagttgattactagagcaaaaacaaattcttgccaattgatgtttatataatgtacatgatagacgcagtaataacatttaaaataagtgtaaccaattaaaaaagcatatatttatgtgacaaatgctgtctgaagcattttgtgtatgtgactccaattaatccttatagctattgcatgaaatacataggattaaattcaattcacagaagaagaaatggcagtccaagaaagaagctgaccacagtcacacaaataaaataaaatagtgccaggattctaacccaggtctgtttaaatacaatgttttctttttgtactaaccatgaaaggaagcttgatttggggagatacaaaataaataacttcatataaaagtacttaattcctcaatacatataaatatatatgtattcatggtgaactggctaaaagttatatgttgagtttgaatgcagatgtttcatatgtactagtgtaacattttaattaaaagcaatggaagcagtaataattataaaccacaggaaagacataatcctattaagagttatctcagtagtataattggctccaggatatcagtgaacacccacatgactgatatttgaggccaaaaacaccttctgtcttgatatggaggattatgagcaaatgaagtccagaaggtaaatatgtcacattttaaaatcaaagtcccaattatagataaaggtgtaatcttacaatgccttattaaatatttttaattaaggtggaatataaacaaaataaaattttctttacagttttaaggactgaagggctctgcaacatatttgtcatgcattcatacagctgagaggcagaaaaataaattggccaatcctccattttgatctcctctttagctgtattgaagcctggattatatcaaatctcatcagattttctttgtcatgatattttacgacaatcttttttcagtctcattgtcttctagttttagtgttccaaactattacttacatttacgctaattattagaattctcccacagtgatcagacatctttattttactaggggttccagctttcagcccttgtgttgttgccagtttatacagagtttggtaagatgctgtattcaaatagttaaagaaaggtatgattgcttaaagatcttccataactgaatcagtattttgactctagatcttcttagtgtccttatcaattccttactgttaatattcatctttttttattattatactttaagttttagggtacatgtgtacaacgtgcaggttagttacatatatatacatgtgccatgttggtgtgctgcacccagtaactcgtcatttaacattaggtatatctccaaatgctatccctcctcccgaccccacaacaggccccggtgtgtgatgttccccttcctgtgttcatgtgttcttattgctcaattcccacctatgagtgagaacatgcggtgtttggttttttgtccttgtgatagtttgctgagaatgatggtttccagcttcatccatgtccctacaaaggatatgaactcataatctttttaaaagtgaatttttcttctagaatgtaacaaaggaggctaccaaattccagcacactttacaattaagcaatcagtcaacaccatttgctatcattaagattaagcagatccaatctaaaaatcaccctccatcaagatccatcattagtcattaatctcccagattttaattaaactaccaaaactattcatctgaattcatatgcaaaggatagaatttttctttaaactgcccacaactttggtgggccaagctgaaaggttcgcttgagcccaagagtacaaggccagcccgggcaatatactgagacccccatctctattttaaaaaactgcactgaaacacatatcaacacactcaactacagaaatatgcagtaccttaaaactacaggaagctaccattagaatcagtgactcctcaaatcagataatcagacacatttctactatccagctaaactccttagaaaggagaaacactttaaagtaaaactatggcccacaaaacagcttaaagtaggaagtacaagcatgttttcaacaactctaactcacaaaatagttttaaaaagttaaagctttaaaagtcttaatttatttaagaatatatttccaaaagatctgcagtgcccagtcaataaaaggaaggagaaaagaaatgactgatgcttacacattcagtaaaaatatatccatttaaatcaataaacaactcatggctttgtataaagtggaatctttattatcttttttggatccatgattctccttcctccccagcagcaaaggcaattatgataaaagatgttctgaaaatttttttgccatctctgccaatttataacccatgactttccttgtttcaaaatttgtaaagtccactttctccaagtctttcccattatgcttctattttccaaattcgctatttttaatctcattttcctagttaatcatacagaaaattcccaattaccttttcaaatgaatagaagtcacagtatcagtaattccgaaaccatttctgtttgacttaaaatgcatttgattttgtggacaatggactaaaatccctttttcatttagggtaaatgtgaattaagtttataaccctttaacattcactaactgatcattcaaggaatgggccttgtgattgtgactgtggtagcagtacagtaacagatagcaacttggtttggctacaaatatatatcaaaagtactagtattcaaatagttaaaagcttgctgcagctgcatacatttcgtttagatatatatactttcaaagtctattctcattatccttgccggtggaggggaacaaggtcttgaacaaaagagtactgtttcaaaataattctcatttcctttcaagtgtgcagatattcacaatatactggctgtaaattcaatctaaatgaagaagtgctgttaagttactgctgaggcctgggaaagtgaccaatgtccaatactaaccttctttgaaaccatcccaggagagtttgtattaaagtcatcgttgacaaaattcagactgtatccaaacagtacactcacaaagcaaaataacttctaaaagcatataactactattaacggactttaaaatgctaatcatttcattggaagtgattttcctgagaataagatatatttttctgttatctttattttttaacatttttgtcctttttcccaacaagatgctgtcaacttgtgacatttgtttattatccttagcagattttccatgtgcaattcagagaggctaacttgcccaaacacacagcttaaagttagacctcaatcagaggcagttggtttcagaagccaggctctgaaccacattaatatatctgaaaaaaaacatgatttctcatgcaacttctatgattacaacaacaacaacaacaattctgagtaatgagctaggtcctattaccaagtaacacatcctttccttgcctatctcccagcccagggatattccagctatggagtttggtgatctgattgttttccatgttcctaaccgtcaaatcctgatgtgatattggattcagactagaaattatgaagcaggcacacaaagcacctttatatatacctcaataacttttcccccagaaacaaagatatttcttggctgtttcactgaaacctgaggttctgtagttagctcatagggaaaagtcagtcactattagagtaggttgttatcatcaccttctgttcttttaacaattgtcaagtacttttcacatttatcaatgtgttcttatcacattcattaactgcttcataccaatatttttaaaatattacttgcttatccatgtatttgaagctaaaacaatgatcacaatcagatctctagacaatggttgtaatgaatttgttcaagaaaagcattcaaatttgatggaaaactgagcctttataattcattctaattcttcaacacaaaaatgaactttggtaaatcaataggatcaactgaggcatttatgcttgaatgtgctcccctaagcttaatgtatttttcctcactgcattatattttaatgattaatttcatgctctttcatggtattctagctcatgaatcacgggtattactttgagggaaaagtaaggtgctgtgagtgatgaaagatgttactgattaaagtgttgcacatatgaactacataagagctgaaggtgtttgaacaccagcaatctagattaaaagtaatattaggcaaactggccatatagactaaggttgaattgagtggagggagtgggaaggatgggcttcttaaatgttcttagttgaaacaatatatgaaatcaagcttggcattcaatgtttcactggcatctttctcctcagtagaatgtaagaactgatttcgaagacaactgcagagaaagaaatcagttaagcagataacacaccattctgaaattaaagagccaaaagccacccatcctaagtcaactccgatatcttaaatcaatactgccttaatactgtcagaagcttgtttttcgacttagtaaataaaattttttaaaaagttaagtcaaagtcacaaggaccaaaaaggaatagactaccctaaatgaaatatagaaaaagacaagtatctattatcctgcacacagatgaacaactatttgttaaatatatcatattgctcaatatcaaaaagtcaactctccaaaacagaaaccaaaagtaaactaaccagagatgtccacataatacactttggctcttgttactaaaatgatttttcaaaccaagttatggagcctggagaaaacaggactacttcctcccagaatataaagtttcttcaattacggaggcaaaatgtggcaaaagcagctattttgcaaacaggtggtttgcaaaacttttacttaagccgccaaaaggactgacgaaaggaaaattttgttatttctaaagaaaacacacacacacataattttctaccagagtagaagactcaaataaagaaaagccccaaacaaaacagaaaactaaaaatcagtttgtcttagctcaaaagtgctgacctaggtttagtatgtgtaaaatcactgttgataattaaatccttttcatcgcatatattaagatactagagagaaaggaaatgccatgtcgtttcaggtaggaccttatttacataaaaaaagattttttttaacagaaacggagtgcaagagggaatcaaaaaccgttgagaggagagaaaaatacagttagtttttctgagggcactgcatttttcatgttctgaatacttcgttccattctctccatgttaaattatttcataaacaatactatgactagaggcgactgctacagctgacacacagatgttttatttctatgcttcacctttgcaaatagcaggattcagctattggaaatgggggcagtggaggtgtccagaaacgacatacaggaggtgaaggggtagaacgtgtgggaaatgggcactcctaccccctagagtccacctctctggaactccagtgcttcttcagtcactgacattcagaggaggacaagacaggcttcctgaaatctcttccgaagtaaacaggtcccgacgcaaagggcaacccctccagtagcggaaagtcctcccctgagctccccgcctgcccacgcgggcctgtggctccgcgctcctccgctcccccgcagagctcccacgggggaaactttcccgcgtctctcactctccggggtgcgggggccgcgggggcctccccggcacctacccgcagagcactccccaccaccccgccaccaccgacgagccggcgcgaagtccgtacctcgatgtccgccgagtccttactgagcacaggggccatggcagtgcctacagtctcgagtctgccagtgacaaaccctccttgcgtcctcaagctccagccagagagccaagtgacagcagccggagcgcgagtcgaaaacaggcagactagggccggcggcgcgggggcggagcgggcgcggggcggcaacgcccccggggcggggctgcgctctcggtcctgcggctcccgcgccaggcacggcagccgcagcccggccttcccagttcagcccgctccgcgccccagcctgcaagcagaagggagggagggagtagagcacccgctctggggactggcctttaatctctaaactgctaaaaacagagctaggcaggcggggccagataggagggatccccaggcaaaggtaaaagcagtccgcgctccaagcaacaacttgcactttttcttttcttccacagaaaccccgcgagatgtagatacattgtttgaggggcaactgcattttcaggaactcctcaaggatgaaatagtagatgttcctccatccatccaccaagtaggtgggcggggtttgagctgcagtggaggataccaaagcaccggtcttctgagagttcacagccccagcggggaggggagggaggcgagcaaaaacatccacagcccgcagcagcatacaggaagtgctgcaggtggtacataatcaaggttgtctttttgcaggaaagtctcattttaatggttatttttttaaatattttttattctaaaacgtgaaactcttttgaaaagttgctcttcgtttttgctctagagcttgctgaggagaagggagagatttcctgtagagttggtcccaatccagaaaacattcacctcgttttttgaggatatgtgtactccagacctctctccttttctccccgccccccccccacccctgttagatgcatcccacctctcttctaccataacactttctacttccgttaggacatttgcggcactccttcatgcacttggctaggtagtgacaccttggagtcaagtatttctcccttattattttttcattagtccattcatcgttttattcaacgaatatgtttattgagcattttcaatatgccagacacagacactgtgctaggttctccggatatagtcttcaagaatacacatcactgtcatggagattatactcaaaataagcaagtaagaaaatgtgatgcctgcttgtaagataaaagaaaaataggacagaataactagggtatgggtaccttgcgtggttgagaaggcttctctgaacaaaccatcagattaccttccagaacctggaaattactaaaagacagatacatttttcttgaatcaaatattaacagacactagaaagttaaatggaaaccttagaatcatctttgactcctttatccttattgcctcatttaatctatgcccaaactctcagaagtcaacctcctaaatagattttgaatcattcatttctccattttgctgcatccaccatggtccaagctactggtattctagcttctattcttacctcatatccataccagattgagctttagaaagtattaactggctcatgccatacaacgatacatccacacacccaggtacccatggtataaatccttcaatggtccattgcagtcagaatataatacaaactccctagtaaccgctgaataacctgctctactccgcttctccgccactcttgccctgactcattatgttccaaccacaaggtaatcttctcatcctccatccacttctctacctttgcacattgccctccacttggagctcttcttccccttctactcatcatttaggtctcactgaagcctttatgatctaaccccatcaccaacaaaattacacccactctgtctttttcattatatttcgtcttcatagacttttcaaatgttgtttaaatatttatttgaatgtgattcatttaatatatgtcttctatttagagaggaagctccaggaagagggggcccatgtgtacttttattgtttactggatactcagttcctagctcaggactgaagcataagagaccaagaacacttggtgattgaatgaacagagtacattcgtttatacactgggcagttcattttagaaactttagtttctctgcatcacatattctcattgtcctacttactgctgagaaataggtcacaatatctatcaatgaatttgtagttaaaatgggtcaaaataactacttatcttttcatggagtaatgttccaaagtcagatgttcctgcatctccctacaaccacaccttacccacttactctagatcctcttggagatatagagagatagataaatctatctatatctatttttctatcagtctatatatataaatacacatataaacacccaaatacatacatacatatacacacatatgtatatattgagaaaagatatacacatataaacatatataaatttacaaatataatatatataattataatacatatgatttcttccccaatttaatcagtcaggttcaatgttcaatttcctaacttacagggatacaggcttattgctctttcaggttacactttaacatacatcttatcagttagcaattgatagttaatttatgtgtacaagaatccaagttatctttaagagttatacagtgtattttcatattcgttttctgttataattctcctaaacaactatagaggataagtccaatatacggtggttttccaaagataagagtttcatcggtgatagtcaataatcaaatataaaatttaaatgctatttaccatcccccccaacttcatcaaacagatgtatcctgttctgacatattaattaaggcatctaatcacattgctcacgtgccacacctatgctctgtgatcagtgatttaatctaataatattttaaattcattgaaattgcacattaagcacagttgtacctgtaaataatgcaagctgtttaaagcttttactgcaaatgcatttgcaccacactttttaaaagttgtaaattatgatggcgtttgtcaagctgtccctccatctggaagcacagtgaaatatcaggtgttccacattaattttttgtaggctttggagaaacagcttatgtttgaacctaatagtttacagtacataaatgaatattattactaccaaagtcagaagtaggacttatgagtcatctttaatttcacatctaaaaagttattcaatattacaaatttagaaacacaacaaaaattcagatttccatatgcctttattttccctttgcagtgtagcattaagagattttttttggtgggggacatttctttgaaaatgatttcctcccaaaaagtcagaggctgaatgatcatgaggtgcattttttccgctgtctgattttcaagggccaaattaattcctacccatattgaccagtaggataatgactaaagatcagttaggcccaaatatttccagcattcctgttaaaaagaccaaaaggaatacgttggttcatatttcatggaacaaacagtataatgtgctcaactacatgtctatcatattgcatatatagatatgcagtatatcagcatgtattatgtaaatgccataaaaagcacagataacacagagaaactacaaacctctcccataaatttatttagcaattatttattgagtacaattgtttcagacactgtcataagcattagtgacatctcagtggacaatagagacattgtctctgttaccacaaacctttagccactaaatgaaaaacaaaaattgccgcttagtgattttaaatgagtggtttaactgaatggattactatgagagtcagatgtcaaaatatatgcaatagtattttgtaaattgaacagtgtcatataaattaaatattacaaatttaaagatataatctttcaatgcccacgttcccacgttctagaaaaatgtcattaatgcatgattgcctatgaaagattttgggtaaaatgcagtgtaaggggaaagtttatagacttatctaacttaaagtgggggaaaacatcctttagaatgaatgtcccctgaaataatttgccttactacttaggggtcttttccttggccttgttggtttcctctcaccatctaatattgtcacaattccaagaactggcatttaaagtggtttcttgttttattgctggaattttattgttttataatttctagttcatttacatttgagcaagttcttcatatccttgccttaaagtatgtattttcccttttggttatctgtagcagatgttatgatgtgcttcacagatcaccacccatcccccaacccattcaaaactgaggcactcattctctcagctcctgggaatgttagtggttgacagctgtctgctgagtccctctctggaaattgcccctggctaagagagacatctcactggaagttcaagccctttcctggggtagcagatatccaatgacagttgatgtgggaatttaaaggctgggcccttgcctcaattcaagacaccttttaggggccatcccaccttcagaggtccctcaagggattagctgggacataagttgggacgtctgtagagttcagcttctccctttgcccatcctgcttcatttccttgctctcactgggcctcatacagacagcactgaataatgaatatacttcctgcacacacatttctattgcaaagtctgcttcctagtgaacctaagctgcattgttacctctgtatattaattaacaaatggtctatactgcatgtaaaatgtacatgcttaattatcatcatgcctggacataaaaattaacccatatttttaaatctcatcatttatttcattgttctgagatgtttctgtatttgttcattcattcttatcactgataattatgtgccgaacacatgctaggttcagtggaaaacactagaggtaccgtgatgagcaaaataaaagtgaactcttattctcctgcgctttgcagattagttagggagatggacatttgcaaaataatcacacaaaaatatatttactgcaaatggcaacatcaatgaaaaacaaaaggctgttatagtagagggccctgagaaatcaatggagtccttgaggtaatggccttactgctgagacctaaaggacaacgtaagagttaaaaaggcaaaaggaggttattaaaagacttccgggaaaggagagcaaagtgtaaaagctccagggtcagagatatccaacagggaaagaaggccctgatggctggagtttaagcaactagtgggagagtgacccagggtgaagctgcaagataagcatgccatgttttatttagtctttgtttagggttttgaacttcattctataagaaatgggaagccatgaaagttttttaaagtagaagaatggtatgatcaagtgtgtattttgaagtattactctgattgcaatgtatgtgtaattgcatattcatatactcacttggttgaatgtgtgaaaatcaaccaaggcaagtgatttctggagatgggctcagtcatttcctgtgcatgctagcctgggtggtaatcataagtgccattagaaaccaaaatagtacatttctaccatatattaacaccgttgcaatttagcatgttgtggcacttaaaaggcagatctctgtttttaatcagaggccagaaagaaaaacctacactccagaaggatttccctctctcagtcactggctctcattctgttttcctacataaaattataatcatcaatttttaatcatctgaataatgaacgatgtgctgttcttgttctgcagtttgttttcatgatttccactacccctacccctacactacccctacactgtaagatccttgataatttttaatgggtcttatctttttatcctccatgcctaacatagtacctagtacatagcaggtaaataaatattatgaataactatcatatttttatcttaaaacttcattgcagatcattatttagcattactctttttccacatagcagagagtatagaaagcctaaggggaaaagatttccagtgatatacaaatagataaagggcatcaatggccaactcacaaaaaagggaatacaagcagttaatgaaaatgtgaaaattgagtcaacccaatcagtaatcaaagcaatgtcaaaaaattataatgacatagagtttttcacacatcaaactggcaaagattttttaaggaaatgaaggtgcaataaaattaacaggttcgtaagattccataatgagtaaaaacttagtatagtatataggcagggcagttgagcaatacatagctttcttagtctatttggctgccataactaaataccatgaagtggttagcttataaacagacatttactgctcccgattctggaggttgggaagtccaagattaaaacattggcaaatttggtgtctggcgagcacccaccctccggttcatggatgatgccttctcgctgtgtcctcagatggcagaagggacaatgcaactctccaggttgctttaataagggcactaatcccatttatgaaagttctgccctcatgatctaatcacccctcaaagggcccacctcataatatcctcacattggtgattaggttttaacatgtaaattttgggaggacacaaacatttaaaccatagcaatagccaaacggtaaatatgtgctttctctgagtcatcaactttatttctgatttttttaagaaaacaatattctttttgcaagatgtatccaaaaatatgttcattctgaagttgttcatgcaaaaataaaatagcatatatgccctataacaggtgactgatagataactgattattaataactgacattggccgggcacggtggctcatacctgtaattcccgcactttgggaggccaaggcaggcagatcatgaggtcaagagatcgagaccatcctggccaacatggtaaaaccctgtctctactaaaaatacaaaaattagctgggcgtggtgctgcgtgcctgtagtctcagctactcaggaggctgaggcaggagaattgcttgaaccccggaggtggaggttacagtgagccgagattgctccactgcactccagcttggcaacagagtgagactccatctcaataaaaaatacataaataactgacattaatctggtgaattcataattcaactttatgcaggcattagaaatgatgttgtagaagaatattaacagaaaaaaacatgggtaattatatatataaatatatatataaagaatatatatcaataaatcgaataacatgatataagatctaaatattcatggacaagtaacaaacacatattagttaattatacaaaaaagtaaaagttattttacaagctccattgcactctgagcagatagaccaatacaaaaaccttttataaatgtgtatgtttgtgcatgcagggtaaaaacctcattactcccacccttgatacatattaggtattctgtaatttttttatatgaagtgttttacatgaaaagctgaataccaaatttgtctataatctatagtccattattagcaaaataattatcatcagtctggagcaaattatttttaagagttatagaaattggcaagtagcacaaactccttaagctttaactaggcaaaataatctaaatatgtggagaatgtcctattataagatagttgtttgaatgttttgatttatttaatctatgaaacagcaatcctgtcagtctctcactccaaacccattatgtcttcccatttcactcagtagaaaaattgtacaatggcctgcaagacatgtatgtatatatctagctttttgtttcttctctccttctcattcctgctattcttgtttactccaactccacccacagagatttttccacttgctcttccctctgtctgcattgatattccacactaggtatttcaacagatagcccttcatcagcttcaagcacttgcataatgaccaccttctcagtaaggtcttctcgaataccatatttaaaattgcagctcacatttctcacattcactaccccccttttcctattttatttttctccctagcaatagaatacaaatgacattctatttgttttagtgatgcgtgcgctcattgcctgccttctcctaatagaatgtaagttccctgaggctgttttgttcactgctgtatcatcagtgtctgaaccagtgcctagcatattgtagatgctcaataaatgtttttgaaaaaactcatgaaacagattgtaggttatagtctcttttcatacttatgtattagcatttaatattctacatttatgtgtctgtctcatccaccagacagaactgttcaaaggcaaggactacaccttactaatctttgaatcactcagtttagacagtgtctggatttaagtagatgtgctctaaatatatgttgattgaacaagcaaatggaataaaaatcatcatgtttgtgtactttcccaaaagcacccacctcggtgcatctttaggtattcaaaaattgaaatttatcatgtttgtcaatcagagaaactctaagctaagagcttgctctgaaacacatttctcattcttgtcttaacaactcacttgacaatatttgataaatacagtcatttgtgcaaaggaccttggtatttccaataaatttgaaaatatttcccatttccttgtatctttccttcaacatgttcaaatagtttaatttgttttgttgtttcaaatattctgagcagtttcttctccatttattaaaaattttattaaattttaaagaatattcacatcttatttgcagaatttaagggaaagattatttggtactttgtgtcttaaacagaataaccattctgaaagtattttgacaatcttttggaagaaccgatatattacgtgcttatgccattgtatgtgttgtgtatatatagatatatacatgtatgtctgtatgtatattttaaatcatccatcatactttttccaattgttgcttaaaatgagtcatcactagattcattaattcaactatcttgttttaggcttcaatgaaaagagcttatagatttttcctttttttatttatttttcttttctgggggttggtgttgcgggtgctgattactatcactcttccaagtagcacaaatacatttcacaatgtgaactttgataaatgtccaaatggattttaaaactaagcaaattgaaccgctttttgagtcccataatttattccagccatctgtgtcacacacacgtttgtttcttaaaggctttatacattttttaatttttttgcccatcttccaacccagcagcaccttaggatgtaacagcattaacatatttcaagattaactttgaccccctgaagaatataataagaagaaaaatgagaaacatttttcaatttaactattttcaatttggagattaaaaagtatagaaccaaaaacattcttttggcatgatactttctatttaaaggccaccaaatgtttctttctgggagattgtattgagtggttaggatcttggcatccactattgttctagggaaagattttcctggcccacacttgttgttcctgggtaatgaatgactagagtatatggacagagccaccttcccatctgtactagctttaactaccattgattgctgtgttgcatcctctgttgaaccatgcatgcttaatcattaattttacttagagctaataaaaatagctgactttattgatcatctactgtatgcccaggacattacacatgatcttttatttaattaccacaataatctgaaattaaaaatgtagaaactgacacttatgtattgtattggagtttcagatacctaatttctttcttgggggtggtaggtaggagttattgaaacaccaccacaatatcgtgaattttatttatttattttaaatgcagtatactttataaacagctttttttggttttataaacgtccaaatggattttattttggttttattcatggaactaacatttagagttcctattttgctaagcaatttattagacattgtatattaattatcatataattaagaaaatcgaggcttcacaatgttaatgctgtatcttcacaagactaatgggtggcagatcttggattcttgcccaggactccttcactcaataccttctattttacatgtctgccttgaaatagagtaatgtgttccctcacagaattttcctattttgctgttctattctagtctaatctgtgacctatgagaatcctgattaaagaatgataatatctatttcatggtttttccttgttagagtacgaaacaaacatatgtatatacctattatatatgactaaatatattacaggtatcatccacatcctaaataaatatgtatagttgtaattgttacgcatagtaaatccatgcctacgcgatgagttgtatcacagattttgacagaaatataatgtgttaaatactttgtcatcttcctctcatcattttaactaagctaaattgctaaacatagaacataaatttctaatcaacttgtatgtgctttgatacaagaagcaattcatactttaaagtagatttttctgggcataagaaaaatttgactaaagtgataaaaatagggaatgataaaagagtttcagattctttagcttagagaagacaaagctggctaagcttgaataaattattgtattcaaatagtttttatcagaatagtgagcagttgttttctattttgacatcaggtcatgaaataggtttaataaattgagacaatgtaattggatataaaaaataacttctttatgtcaaagataaaatattagcgtggactaccagggatgatatgaagtctttatcctggaaatctgaacaaagaacataaacagccatttatcccagctgcaaaaagcaacctgatggacaatgtgatccttaatagtcttttctaatgttttgtttttatagacatcataactttttcttctctttcctttcacatatccctgccttttatgataatagtaccttaaagcaggagcgatttctgatttttatttttaaacatacctgactataagatattaactgcaatttctcttttacgttaaattttcaataagtgaaaatggtaatgtattagccagttcttcaggaaaaatgcagatttcaaggtaggtcacatttctattatatcccataacatacatacagcaattagattgatggttgaaaaacatatttacatcataacactcccctgttaacctatcaatggattctcattaaaattaaagtaaagcacacattacttacattggcctacaatgactatacctctgtgtatctgtgatctcatgtcatctccattttactccagcttataccacgtcagccactgtggctttactatttatccagcatattaattctaagctctttctattatttgtacttggatgaatatcaaaatggtacacagcaggcaactattcaatgatgttggatcaggatcttccttaagtaggaaaaagcaagtgcaaagtcatcgacttccctttccatcattttcccctgaatatgaatgggtacatatacacatcaatgcccatcagtttctcccgatcgttttctttattctatatacgctgactttgtatctatatctgtatacttgtatattgtcagtttcttcttctctaccatgagtattgtgtgttctttgctgtgttgcctacacctagaatggtgcctggcacatgatagacacttaataaataaacctttcacttcactttcaatttaaaagtagatattatttctgcaatgtcaaaatatgaaaaatattgtttatagttgtgactatagttgaagtcaatatatttgtgagtgaatattatactttccatccatatagtttgtcatcatggaaagagagccgtagtctaaaggtgaagtgggaagtacaatttgcaaaaatcattaccattcctttctaaatccaaatcaaggcttattgtctttgggtaaacatgtattatttaagaaacttatactgaagttcttctctccatataagaaaacgttttctgttaaaaagatgtgattctctgatgtgagaagaatttattccattccttatctgagaatttcattaccatttgcatgttgcctggaatacaaattgtactgagtaatcaatcattgtttaattgccgctcaagtaaacccttgtaatcagacttgctataaaaatgttaaggtgtgcaaaaagcataaggtggcattttcccctccttcttattatgcctgtgtaacttccattaatactaataggaggcacagctggtcgtcaacaggagattacaggttgctgtttaaatcatattttatttttataacttggcaagatttatgtattgaaatcaggtggccagatttttgctgttgttaagaaatcttttactctgaaagaatgagattggggggtgggaattgggtctcacattttttattttaggaatataaagactcgaaatccaagcagcagcttgtccttatacagcaagtctgtcttattctttagcaccagctggagtcccgtttctaatttgctgtgaagaattaagtgatttgagacccataccctggagtatttgacctccaatgtcaaccagctagcttgcaattcccttggctggaaagtttctccagaattgatttgaactaacatcagttaaaacactctgaaatatggtagtaaatatcattgcaaatctgagtatgactttatagccgtgaaaataaacacactgtagaatattaaagaaaagagtttaggagcatggagagccttgaagatcagaaatgttgtggcaatagaacgattcacctcagggtcgtcagtttaagtctggcacagttggttcgctacactgtctgaagatggttgtttgtagcatatgttaactgtgccagtgcttgcaaattcatttcatagggttcaggtccatttgtcataaaacagttattcctgttattttcaattgccacagtgttgacaatcctagaggagaatagaaggactaataagaacaaagttaatgcagtatcttcgttaccccaagcacaagccagtctcctttcccccaatcttcattttctcatgctgttgccctcactcacctagattctctccatttttttttctctatacttaatctagtcctttaaattatctaatgcattccttctccctctccatgaaacttctcccagttattcctgttactggtagatttctatcattcctgaacttggttggtaccaacgacctgaaattagatataataccagtgcaactaagtaataaggtcaatagtgctggaaggattggtaggtaggaggacactgtggtagccagaagaataaatatcaatgtccccataactcttttgaaactcctcagtccttattctctcttcattttttctttttccagctttcatctcagttaattaaccacatcatatgaaaccatatcctgctcctcaccctgaaatctctggctgctcaccctagaaacaccacctgctaacaacctgcagtgctggtatccatctttggccaccacctatcctaacttgctggactagcaccctatgccaagaagggtacaaaaaacgtatacggaagtaagtcctacccacatgagacaataaaatggacggatgagaaagtggatagaaagtgccaggcgttagtcgagatcaaaacgtgttaagtgcagctgggcatggtagctcacatctgtaatcccagcactttgagaggctgagatgggaggattgtccaggaattcaagaccagctgggacaacatagtgagacctgtctctactaaaaattagaaaaaataaataaataaaccaggtgtggtggtgcatgcctgtattcctaaccactggagagactgaggcaggagaattgtttaaccccaggagttccaggcttcagtgagctatgatcaccactgcacttcagcctgggtgatagagcaagaccctgtctcaaaacaaaacaaaacacctaggtgttaagtgtgcattctggttggaaaataattaaatagcgattacctttcacaaccaatttcctacatatattactttcatatgtttattgaggtacttggtgcatctaatactatttttcaagtatactgtaagttaatttagctttatgcctttgtgtaatttccaaccttgaacttgcatgtttttttccccatgagtaaaacgatgagactgagtaacaaaaatagccaccatttattgagagattatgttatgccacacactcctttaagtgcatgatatacattatacatactcatatgatacttaattatcaatccagaagatattattatgcttattttacagttcaggagaatgggcctctaggagtttaagttccttgacccaagacactacctagttaggcacattaaagacctagcctgagattctgtcacaatacatcaaatttgctgcaagaaaatattatgtttgtgcattcaactcagtgctttatcatatatagtggaaaaaaggaaggctgtttatatgctattgtacaccaattcttgcttgtttaagtcttttgttactaggtcagattttgagtgtaatattccagtaattgatatatgcacttcttgttcgtccttgacatcgcatgacacctcatggtacactgaataaatgttcaacaaataaatgcatgtggctttgatttgatgttctgataaaattgtgggatcttgttattccttttattttcaattgccacagtgttgcaatcctaaagaagaatcgaaggactaataaggacagagttagggtagtagctttcagggatgtgaggtttgaaccccttggtttaaaattgaaagaaaaatttttcctacctcctattacagtacctaagaccgtatgcagtacacatcctggttttctagtaatgaagttttaagaaatatgtgatcactttcattcacatttttttctgaatatgtgataaaatcataaaacacaaaacattaaaggggaaaatacaaaatactcataattgtactatcaacatttgaatttatatcaatttatggaaattttgatttgttatcttttttacttaacttgaaatgtgatttttagtagattcatattattctaaattttggatgttccctaaaatattaatatgtgtaggctaggttatgctacaataacaaatcactccagaaatttcagaggcttaatgcgacaaaggtgtatgtcttgctcacgttacatatcccatgtgggctggtagaaagcttctgctctatacagatacacagggacttgagctgccagaggttgcaatttcttttgattataccttcaggaacatatggcctcctcagtccaagtggttataaagatgcagaaatttctcacctcaaagtaaaatacttaaataagaaatgacatatgtcacttctactcatagttcaatggccagaacaagttgcattacagtgcctaattgtaaggggtgtgcagactgtaaaggaacacatgggatattttatgtaattaaccctcctcaatttctttcttaaatagatgtccctcagttttatatttagcagtgttttctcaaagttcggggtataaagaaaggcatccttccttttttcaagtgttaataaatctgtaatagttactagcctttagacttcagacttaggttcactcaaaatataacttacgtgttctataataaaagttaatttctattttgaatcctcaatcagccaagtggcaaaacaaaatctcagccaatctaatacttcttctcccattcacctagagtttcttctaaatttagggggtagcaaagtgcccatatttcaggcaggagagtgaggcacctgggccctagtcatttgcatgttccagtgtggtgactgatgagatgagcatcacccattctattcgctggtccatctgcatgagtacaagaagcttctgtttcctaaagaaaagactctcaaagcgttgtgttctctctcagttgctgctgtgccagtgtgggcctcatattctgctctgaatgtgtcaaagatggggtgctggcaaggggatgtaaaacatcagggctcagattcttttctcagagtcccagtagtgactagtttttttcccttgatagggaggataggaagtgtagaaattggctgattgcatattctcccaaatcttacaatgtaccgtaacttcaggttttgaaatcaagaggctaaaatttgacttttctaaaacttgtcttctgttttaataactctcagctgaagctataatcccgctgactgagtagaggcaaaaatgaggaaaaaaagttgaaaaatgcatacctttcatcaaaatatcattctatgaaagagatacatatatatgtttgtgtatgtaaatgtgtgtgtgtgtgtgtgtgtgtgtgtgtgtgtgtgtgtgtgtgtgtatttgttgttgttgttcacattgaaagagataatgctgcctaccaaactaataagtcctttcttggagaaattgccaaacctgctgactaactactcaggtttcctgtgggtaaggtggtcatcttctgcaccatgcaactatattatctaataaaacctgactatccagtgtttatttgcaatcccagagccaaaattcttctttaataatatgcatcccaatcatattcttaacttagtattttacctggaggcttaggtgttcccagaaatacatttttaaaatgtattttagaggtggtggtgatgggataggggattattatttgtatgctcatttgttggttagctgtggctttagaagagccattttgtctgtcattggaggaaggtgactcactagttgtaaatgtaattccctccctttctacatccagtttccaagaaggaagacttgccactgtgtttctaatgagtcattttttaatcatgctgcccatcaagcaaagacagatgaatagattattttttcatttttgtggatagttttgcaacccaataagcacttcttcttgagacattaatccactttatgagagagaacaggaccaggatagtggagggtttatgttttgggaggcagttggagtgggtagggttaatgagagagtttcctgattgggaaatgggaaggagaggaaaagaaaaaggaagtacaagttccacagagtagaggccccctgaatatgtaggttcatagaaggagaagcctctgtgggtccctgtaaagacttagcactcaatttcgctgtttcaaggatcttggcgagtgtctctcacaactaagccaggaaaagaggaagttcatcttccacgggagccacagccatcataaaatgttagagtggaatgaccagtgaatgagtggaaaatgcagtggaagagtaaagtttaatagtgacagtgtataatccctagacgatccctctacttttaacagacttttaattttagaatagttttagatatagagaaaagtttcgaagatagtacagagaggtcctattcatctcacactcagtttccattattgtaccttcttacattagtatggtacgaatattacattcatgatccaatgttagtccattatcattaactaagttcctaccttactcaggtttccttggcttttacctaatagttttcactcgtgcaggatcccaccagtgtaccatactacatttactggacatgtctctttaggttccttttcactgtggcagtttctcagattgtccttgtttttgatgacctttgagtagtactagtcagatattttgtagaatcccttaattagatttgtctggtatttcttaatgattagattggctaaagatttttaggatgaagacttcagaaggaaacttccatttttatcccatcataatacaagtgtgtgctagcaatatgacttatcactgttgatattaaatttgttcacctggctgagatattgtttgtcaggtttctccactgtaaaattactctcttcttctatttcttttcatagtgtattttttagaatgaagtcccttatgagaagaccacatataatcattagaaataagaaagatcagcggggcgcagtggctcatgcctgtaatcctagcagttagggaggccaagacgggtggattccctgagctcaggagttcaagaccagcctagacaacatggcaaaaccctgtctccactaaaaatagaaaaaatttagctgggtgtggtggtgcgtgcctgtaatcccagctactcgggaggctgaggcaggagaatcacctgaacccaggaggtggaggttgcagtgagccaagatcatgccattgtagtccagcttgggtgacagagtcagactctgtctcaaaaaaagaaaaaataataataagaaagatcagtggtggtagggaggagtgaccagattggagaataatataaaataagtagagtttgatttgtgctttgaaaaaaaggtagggtttggataggtagtagggacagaggatgggaagttatgctccccctccttatagccaagtacctacatagattatttggaattctgcatgaaagctctgtttattctcccctatttatttacttattcaattatttatttatattaatatggactgatggattttttttatactttgagttataatccacactacttttttttttattgttgctcaaatttttccagcatttgacattgagagctttttcatttggctccagtgtccctttgatatgcctccttcactcatcattatgtgtctgtgtttgtgtctctgtgtgtgtatgtgtgttttaacacttccttactttttggcactacaatatgccccaagcttatcttgtatattcctagcctcagttttggaatcaaccattttcccaggtaacttgcttccttcaattggagaaatgtacattagaaacaaagatctgggcactaggtgtgcttattgctattggagtgtcatttttctaggtcttctcagctgacagagcaaaaacaaatttatgtatactaacccttgtatgcacatttatctgtaaatatttccgtaatctgctgtaatatatagaggaaattaaataatgtgctaaattaaacatgagttcatactaatgtctctaactttaacccattgctacattgatcattctaaccacccctagtgtttttgtaacttcccactccaacagtgagaaacctggcttccaccatccatttacttaattcttcagttccagtgtatatgtatggtagtgtcagaattgttaagccataaccctgcgggaaacaactttgtcaactatactacattgcttaggtaccatgtcttttgtcactagctttgtggactccacaaacttctggagttgcttccatcagtacctttctccctactttcttcagtgaggttatttcatccacttgtagtagagttagattcttctgtcacacgttgccttccatcatgggatttcttaatctcctatatgattttgttttaatttacatgtgttaagctttactgttggtgctataaagttctatgggttttgacaatttaattgtcaaattaaattgcatttaatatatatgcaccatttaatatgtatgcaccatttaatatgtatgccataccatttaatatgtatgcaccattataatagcatacagaaaagtttcttgcccaaaatatccgctgtattttttctatttaaacctgccctctcctggaacccttggcaaccaccggtctgttcactgaatctatagttttgccctttccaaatgtcatatacattgaactgtaagttatgtagcctttcagactaactgctttcacttactaacatgcatgtaagtttcatgcatatttttgcataacttgatagctccttccttcttatcactaaagagtattctattgtttggatagacaacagtttgtttaacctttcacctaccaaaagacatcttggttgctttcagtttttgcctattatatataagacttctaaaaactcgtgcagatttgctttgcagctttatcatttaatttttttaatttagatataatttgcataccataagattcatctttttaaaatgtatttttaaatatatatttcagtgtttcttagtacattcacagtattgtgcagccatcaccaccatctaattcaagaatattttcagcacccaaaaccatgtacccaacaattatttcccattctcccttgcctccgacccactaatctactttctgtctctatagctttgcctatctggacatttcctacaaatggaatcaaatgatacattaccttttgtgtctggcttctttaacttaacacagcgttgtcaaggttcatccatgttgtaaacatgtgtcaatcattccactttatgtctgcatattattccattatatggatataccacacttcatcttttcgtcagttgttggacatttgaattgtttccacttttggctattaagaataatgctgctataatcatttatgtacacatttttgcataaacatatattttcatttctcatggatatatatctatcactgtaattgctgggtcatatggtaactctttgcttaactctttgaggagttccccaactatttttgaaagcagcagtactattttagattccctccagcaatgtttgagagttgcaattttgccacctcctcactaacacttgttattgtccatcttttttattatagccatgtaatgggtgtgatttgatatctcattaagattttgatttgcatttctctaatgactaatgatcatgtgcttcacatgcaggtttctgtatgttcataagttttcaaatcagtttggtaagcacctagaagcactattactggattatgtgttaagattatgttctcttaatttttagtcaatcaaataaatgtaatcatctaaaacaaccaatatttgtgaactctcatctgttacaaacaatgatagctagctagttgttagccagagaggaaacagaaaactcatgttgttctatgttattcttccctgagtgcaaatgattattgcaccttctaggggagatgacaaggtgctggggtactttcaggtgtcacaatgaccatgtgtgccacaagcatttagtgtctgaggatgaatcaatattgtgcagtgtgtgaaagagtcttgcacaattaagaaatgttctattcctaatgtcaccgaacatcccagatgaaattaatagacaaatgtaggagtcaacagaaactgaaagacagaaaagatagaaggtagagttcaaaatttgcaagtgaaaaaacaagtatggaaaggaaatagtggttaactgacaactttctgggactgataagatctgcttcctagaaatattttgagacttaaataatctctgagacctataaatgtcacagtctttgagactgttgtttttatttatattttgcatcttcatcctgactatctaacattatttagattaccttactgagtggcctttgcagtcaaaagatgctaaccagcacacttttttttcctataaaggtacggacagggtggaatttgaaggaggtgttaaagttcccactttactctgaagttattcattataagctgttaggactaacatttgcattgtggttaaaaaataacaagtaattgtggtatctttaaacattaacctggcaagctcattatttgggatgctttgactaattatttttctttgtgatgctaatgaattgctttctgaggtctcataaaattatgaaattgaggctaacataaaatcaaatatttggttaggagaaagtagcaagtgctttgcatccttattccaagtatgtgggatagtattctaaagtattattcagcattataaaccaggaattaacacagaaaaaatgaaaatttcttaatttaattcccattggtaggatattgtggtgaagtggaactttttcaaaaaaaaaaaaaaaaaaaaaaaaccaaaaaacccaagtcacactctgtacataccaaagtgtttaatttccatttagttgatttttgcatgttaccaaaatgctaaattcattttcccccaacaattaaagaatagaatacattgttctatatttctcgcagccaactcagtaagtagtgattaagccttctggcagtctgttccgttcatggcccccagtgaacaagtttcctggtattcatccccttgtataattctttcccatcgaatctgggctggaccaatgacatgcttaatcaaaagaacatgtcagagtgccagttccaggaccaagctttaaaaggtctggaagttttcacttttgcactcataggagctctgagcctccaggcagaaatacagctatgcttctggaaagggcatgtgagaagcaccaagcagaatgagagaacctgtgactacatggaaaaagaaagatgcctagctctctcaacttcccgacctgcccaccgcagagttaccaattgaattcacccacagaagtgaccagcagcaagacaagcagaagaatcagttgctgagtccagcacagactgcaaaattgtaaacaaattaaatagttgttgtttcaagccagtaagtttgagaatttagttttgaagcaataaaaaaaccatggcacctgctatatatccagcactacataatttgacaaggaagcacaaaaaaatagaaaatgaaggagtgatgaacgtttgacttccagttgttgagctggattatggtgtactacatcttttctttttttctttctttcttttttttttagacgaagtctctctctgtcgccaggctggagtgcagtggcatgatctcggctcactgcaacctctgcctcctgggttcaagtgattctcctgcctcagcctccggagtagctgggagtacaggtgcatgccaccacgcccagctaatttttgtgggttttttcttttttctttttttttagtagagacggtgggggggtccatgatgttggctaggatggtctctatctcttgacctgatgatccacccacctcggcctcccaaagtgctgagattacaggtatacatcttttcataagaattttggaaattatgtttttatcagtaatatgtttcagctacatttcagattatccaaaatatggctggaatattaattatacttagcattttttaggcaaatgaattcttcaacttccaacaagtaacttatcaatgaactttgggaacatattaatttactgggtgttactggtatcatgacatgcaatctttcaaggaataatttccaattattacaataagtcaagcaagggagaaatttggacttgctgtgtgatacaaggaagatgcaacacactcagtttcaggaactgatcggaaggaaagggtcggaatgagccaggcataaaagaacaacaaaaacattctagtggaggaagccgccatcttagaagggtacacaggatttggtttataatcacactggatggtgaaaaggatttttatgaaattactcaaagataacaaggaaattacatggttaggtcatgttttagaattatgaatttggcagcaattcatagtagaagagggaaagattagacaaaatctttaaaagacttcctgacatccagtattttcagtagctttctccagtattcaaaagagattttttttagttcacattttatattttcaagtgtaaaataatgaaataaatggcagtaagtacacttattttgcagtttagtcaaatgttttcacatgatgtcataataatatcaaattttcttgaccaaatatcgaatcatttactcaaataactttgatgatcccctgagttcatccatgatatattaaataaagagatgtatggtttttacatgcatgacctttgatatcctgaagaacattttataacgactttccttagcaatatttttgtgaatgtatatgtttatatgtgtttttctcttttcgattttttattctgagcatgatttttaatattctgccaagagagtaaatagcagagcattatcttatgtacttagctgtatttccttgtgaggagaaaagatttttaagaaaaaaaatcagttgggtactaaagaaataattgagtcaggatgaaaaagaaaatgaaaaaatcctccccaattcttattttagccctaaatttcttttagagtatcttatgtcaatgtacttcatattgttatttgcagttgcatagactgtatcacaagaactaagagaaaaatatcttgctgggatttactaccactataggctttgtaaacaaataatttgtttatacacaaatatattatctaatggtctgacacagtgcctagtaaacagttatggccagagttagtgcgagaaaagcagatccataaggtctgttcaatttatatttctaggaggatgagctgggtttggattccttctaacatgtaacttggatatattgttctataaaactttactgaaattgggggaagtctttccaaattaggtaaagtgttttagagggcttagtgcttaaatttcatgaattggtctcagtgctgatctgtgctttagtggcatatgataactacttcaggcattttctatggccagaattgatgttgtatgtgcttctgtgatttgtagtgttatgtcatatcactggattacaggtaattcatttcccattgaaatatgtagccatgaccaaccacagtggctcatgcgtgtaatgccagctctttggaaggccgaagcgagcagattgcttgagctcaggagtatgaaaccaacctggccaacatggtgaaaccctatctctactaaaaataaaaaaaaaaaattagccgggcatggtggcgcgtacctggggtcccagctactccggagtctgaggcgcaagaatcacttgatcctgagaggcgtgattgcaatgagcctcgatcgtgccactgcactccagcctaggtgacagcgtaagactctgtttcaaaaaaaaaaagaaaaagaaaaagaaagaaagaaaaaaggaaaaaaggaaaaaaaagaaagaaaagaaaacgaaaaaaagagaagaaatacgtagccacaaacttcaactgagtaaagaatgaatcaaataagaagcatggtgaatgtttctaaaatgcaaagtctgtatttatttttaggtttgtatacattagaatctatattataaagtatggaaattcttttaaaatccagaaatgctacatgtttttgaaaagcattactctaaatggtataatttaggtttaaagtatagtttgtgataaaatattaaaggtagtttttgatttgaaatatttaaattagagctgtctatagattaatttcaaaattataactcataatcagatgttaattctaattctttttagtgtcatataagtgtaaaattgtatttttatctctaaggtagcataatgaactgtgaatctaagatttgaaaaacggtgtactaatgaacttataattccttggtgcatatgttgggggggcctttttcaaagcatatctgaaagtataaagaatctgtttttaatgtttgattagcagcaaaattagtgggctagaaacattattcataatataatagaggtgtaggaaagttggaaactctccaattggatatttatttggaaacagggacaacttaattgttctgaggttgagagacaaattactgattacattttctcagtaaaggtttctttttaaaattaaaactaaatttgtttatatattttactgagaaaatgctcatctcctcctgcataatggttggcacatagtaggtgctcaatacatatttttaaattaattctaagaagtgcaatatgtccattaattttgtctattgggcatgctgcttatttgaacttggtgaaaattatggattctagtttttctattttatgaattagacacagtcagaaggtatgaatgttgatgtcatttttggtgattttattttgaagtaaaaatagataaataataaaaattaaatttaaaatttaaattctaaatttgtgatttatgatattttgactcaacatttctatttctagtgtacaaattatatctgattcctgggaagtattaagggtaatttgttgtatatcgaatgtttttatcttttttataatacctcttaaaagtggtttttgaatataaaccttaacaatagaagaaagaatgaaagtgcttacttattaaatgaaatatttagaggggtatttcttaagctatatcctctcaaattgaaggtaagaattttctaggcagcataagaaattatgctaaaatgagttccctctgtgcatgtgagctggtatatattcacattagtgatgtgtatcttttacaataaatgggaaaaataaatacttcttgtagttgagtggaaacttcattgccccaagttgtgtatgcattagataaaagaatgttttaaatattcaaactcggtatcatagttatatgcattaaggacattcttccactgtatggaagaagcatgcttatgcaagcctggagtcgggaagggaaaaataggatcaaggatcactaaggatgtaagtaaagatagccatgaactaactaaccacaagtatgaaaatacttttattattcattggacaagaaaattacagaaccaggcatttggaaaatcttcacatactgacgtgtggtttcagtttaaaaggtgctgctaaatagagacagaaacaagctcaaatattcccaaatgatgcttgcatctgaaagaagaggcagatatgtcaagctttattctaatctaccactaaatctgtctgatctcatcatcaagtatttattaataatctaacatttatgtgcatactatactatgttaaatgacaagaagacagagcatcattaagtatactgtacaacaatcttaagttgtatagtcttattacaaagccaggcatccacccatagagagtaaactctggtatcatctgctttgttccaaatatgtgtaaacaaaaacaaaaatgctatattcagctattatataaggtgaaatatgataattgttcaaaccaaatagcattggtacctaaagttggagaaattaaaattggggaagaagtcagattttaacagtctaagatttgatgtaatggatataatgaagtaaaggcactaatattagaaagatggagtaagatgagggagtttccacaactgagcatacaacagtatagtgatgtagtttcaaatattggactaaaggatactaattatattaaataatcctgtaaaactatcaaaagagatgttgaattttaggaaggaaactctgatagagggcagtgaaaagaatggagtgaaggtgtgggagacaagttggaaagttttaataatccagatgattgttataagactgaaataggacaagaacagaatgaatggaaagcaagaagtagatgatgttgcagagattgaaataaaaatattgcacatacaaatagatgtttggacagataaaattggtaaagatcttagtaactagtatttgttacaggtttttacatctatattcatgagtaatattgtctgaaattttatttcttttagtgtcttgtctggtataggtgcgggataatgccagcctaatactgagtttaaatgtctttctatctcatctgtttcctgcaaggatttgtgtagaattgttactatttcttccttgaatattcagtagaattcactaatagaatccaattctttaatagatacagagctacttcttcttgagtgagctttggaggtttctgtctttcaaggaatttgtccatttcattgatttatgaaaactattggcaacagtttttcataatattttttcttcttcctttattttcatgtcatttgcagttatattctctctatttctgacattggtgatttgtgtgttcattctgtttttacttgagcagtttggcaagaagtttattaattttatggatctcatcaaataattagctttcagtttcactgattttcctctattggttttgtgtctcctatttcaatgatttctgattttatctgtattgtttcctttcttttgctttctttgaattgaaattgtacctctttttatgtattgttaagatggaaatttataacattaatttgagaactttcttttttaataaagacatttgatgcttaatttcctttttttttttttttttttttttttgtgacggagtctcactctgttgcccaggctggagtgcagtggcgcgatctcggctaactgcaaacctgcctcccgggttcacgccattctcctgcctcagcctcccgagtagctgggactacaggcgcctgccaccacacctggctaattttttctattttttagtagagacggggtttcactctgttagccaggatggtctcgatctcctgacctcgtgattcgcccgcctcggcctcccaaagtgctgggattacaggcgtgagctactgcgcccgacctaatttcctttttacaactgtattagctgcaccctgaaaattttgatatatttgttttctaaagttcgtaatttcaaaatagtatcggttcccatttaatcactatgaaaattatttggccttggtagggaagatataattattatatagattacaacattctagaaatgaagattcaggcaaatcatactcagatctgggttttcaaaccagataatctgcttctaagcatcttgctcttcacactataccacatggcttcgtgggctactttacaagttctcaagtgtggaagacttgaagaaagttgaatatataagccaaagttttgaatacagaaagagaaacagatttttttttttttttggaggggaagttagttgttttatcctatggtgagctgaagctattgatgtgagaaataaaagggctgtctggataaatgctcataccttgaaacatcatgaaatctgctcttagagactatttcatccagaagaaaggcacttcccattttctatttctgagataccgttaattgaattggactaaatattgtttcgttttcctcccaactacagctttccatattcaggtacagacttcagttctaaagaagcaaacaattagaaataggatactgaagatggcacagtggttttcagatatataaaatctatgagtatgtcctaacagaaagttgtagaacccagaaaacctctgctcagtatgcatcctagtcaattacatgttatacaaagatatttacattattatggagtatcagagtatcaatcaagagcataaaaagatgtcctctcaaaggaggaagggaataggcaaaatctgatagaaactgaaatgtatgggaaatatacatgtattatcctccctgtcaaatttacgtctgaaaaggttttccagaatcactgttggaaaatgtgctgggacaagacggtttgctcaccatcttaactgacacactgtaagtgtaattagttattgtcttctttaagaatgaggaaaataaataaaataaaggccaaacttgaatacgtgaaaacaataaaaaataatagaaagaaaagagcttctggataacttagtagaagaattttgtttctgaaaggatttgctgcaggaaccagaaaaaaatactatcagaatacaattagcactcacggaagtacacaagaaagcattatttttaataaaagaaggataaaactatgttaagagacaatgttcatatgaaatggtaagagagtaacttaaaatattaaaggatggtgatgaaatttaaaattatattaacaggatgaaaatccaaaaagcctaataataacgtacaggctgaacttggagatcaaccagaaacagaagaaaagaatattaaaacagtagaagatttacctattttttgtctctgatatttctgtaaagtataaaatatgagagtcagatataatccatgggtcttgtcttcagaaaatatgtacagataaacaagcatatacacatagaattcatcaatttccaaggatttaaagaacttctaaatggcattcatgtatcccatgttaggtgaaaaattcccaatatgcagcggagctgaataatctagtttaacatttccaaaaccaatactcccatgaacacattattttcccccaactggttatgaccactcaaataagttttgggaatgctcgggtaagtaatattaagcagattccattacttcattacttttcagaacctcttataggcaatgtctcaatatatagctctttcaaaatgtgcttactctctgccaggcattgttctaagtgtttcacacttaaatcctcctaacaatcctatcagataagtactattattttctgtattatacatagaaactgaggaaaagcaagattaaataacttgtctggttcacacagcctgtatattaaggaagctaggatttgacagtatggtccagagtctgtcatttaccactacaataaaagcaggaagtagagcacacagggatgatttaactttttattttgaggtgaacctattaatattccatagaagtgtgctttatagagcatagtatggaaagtagtaaggtgattgattagatagattgaaccacatgtaaatacatatgaaacttacacatacacacacagttaaataacttttaaaactaacaatacaggaactatttacaaaacctgatcatctatgaggtaacctaagatgtctcaatatattccaggcagacttcgtacattatatattatttgataacaatgcaatgtaactaaaaattattaaccgtattagttataattacagttgctgatgtagggtttcaaaataaagggttttaaatgagatagaaatttctttctttctcatgaacaattattttataaacatagggcagctccttggtgtcaggcacccaggcttcttctattaatacttgcttattccacacacctccaccagccatctccaccctggggtccaaagtagctgcttcagctcctgtctccttcacgtctgcatttcaggcattaaggtgaggaagacacacttttcctttcagagtaagagtttgcaccgtttcatcattccatcactttcactcatatctcctcatggaatttagttacatggcaaacccagctacaagagaccctgggaagtagcactctttaggctggtggtcacgtgctcagctaaaaatatgttaccatataagaagagattaactgatattgaggtgctggagcaaccagtagcttctgctgaacagaaagtttctcttaactcagataaaagatgaaatcaaaagtataattacggaaggtttaaaaccggtaaaatattgccaaacctaactccaaagaaaattgaatgctttaatgaatgtatattaaacatgaaagaatgaaaatgaatgagtttatcattcaagttaagaagctagaaataattcttccaactgagtataagaaaagcaaggaagaattaataaagatacaaatgtagtttaataatttataaatgaaaaacaagttgaattattaaatttgaacatgggctcttcaaaagaccattaaaagagataaactgcagaaaatacaaatcaataaaaaagaagatgcatatctttaatgttatatatgaaaaagagaatataactacagctgtaaaagaaaattaataatcataagattaataattataccagcacctagtacagtgcctggcaaagtacctgacataagtactaggaccttaattattacttaattaattaccgaataaactctggcctacaaaactcttgcctataatatagaaatctattacaataacaaaatcagcttaagaaaatcttgagatatgaatcaccaaagcagagaagaagaaaggaaatcaatctttttctggcacattctatgtaccaggtgttttacataatttttgtcttttatttaagcttcgtaaccctgtaaggaaggaattctaaatttcaaagcttagaaagttgtgatttaaaaagattcagtctcagacagtaaatgattgaattggtgtctgtactagtctgcctaatctgaatgttggtgttctttcctctgcactttttcattattttttagactcctctttcccgagaaaatcctaccaacttccttatatctgagcaggtccattttatctattttactggtttaaatgatgggaatttgatttgtgtgatactttttttgaaaaaggagtttgattcttacaaaatatttttgaaaaatggttgcatctatgtggaagggaacttatctatgcagaaatttctctcatgtttcagtacaaaccatattgtttctaatcaactggtctgttttatctttcagacatttgtgggcattataattgactgtgcttttctctcgtcttggctggtgggaagataaaaaagcggaggccagtttatctctaaaaccctataacacaatatcccatgtatgttttttgtgctaatattagctctgattttattttccccctacatgttttatttgactttttgcgtctttattttatccatgatattctgaatatttttgttagtcatttaaaagtgaatgtgtataaaaatatataaaactgataaacaattttcctaatcacgttcttatttttgaatatttagttgctttcattatacttttctgcttttctaacgtagtttactagtttgctttggcactagcaatgtttgaaactgccagttttaccactgacacatttatggtggatactatcataacccatatttactttaatattagtaataataggattttattatagaaagagaagaaaatcaggaatgggaagggaaagtataaagaattcatttgatcacagagtaaacaccaagaatagtggtgagcaaaccaaatcatggtcgaaaaggatatggcaaactcaggcttgatttgttctgagaatatcaaagtataagccagtagattggaacagagtcagcaacaatttcaagatggtagtaattcctgtggtaaggtaggtggtaccatcaagatttcagggcactgtttttcagtttaaagcaaaattcagctaattgctagcagtacagatcagagtccagtgcctagtccagagtctagcagtcatcagagctgatttgattggaaagaaaatacttattttcattctcatttttgataagctcatcagcctagcaggttcttaaacatttagttattaaatttacctcctcattaaaactttttaataaactatcctactagctattgagatattaatgttttattagcttctatgacctctttgtatagatatatacaatatccatatatagatattcaccctttttacttttgcgaaaatattttcctggttttttatttaaatatatgtgtatatttacaacttggagaatttgtgttagattttaagtgtttccttttgaatgtattgatcaccttgagagatattgcatcagatgtaattccagttattggcatggtggaatgccttgcaatggaccaacattcctgttgagaacaaaaaacggtgatttttttaagtgcatatgaactctgtattttctgctcaatttttttataaatctaaaattgctctaaaataaagtttattaattaaaattatacaagtgttctatggtctgaatgtttgtgttctcatcaaaatttatatgttgaggtcctcacccaacaggtgatggtgttaggagatgaggccttttgtgaggtgattgggtcatgagggcagaaccctcatgaatgagattactacccttatcaaatagacccacgggaggtccttctttctttccaccacgtgaagacatagtgaaaagacactgtctataagccagacacctttttccttggtcatggacttcccagactccagtattgtgaaaaataaatttttgttgtttatataccactcagtctatggtattttgttatagcagcctggaggcactggtgaacttcaagcattaataggactagggagactcaagattttggatgcagacacagtctaagacaagctcttagactgatcatagttttttcctgaggatatttgccaattctggtttcatgataagcgtctgataatccaggatttcctcctgcagcagaacaaactccagggacagagaaaagagcagagctttggtagactccaaggcttaaagatgaaatttgagacctgtggggataagatcctggcaagaagggagggatagaatgacattgacacttgacaaattttcctcaccagatatttgccattttctgaagctacacaggtgacagccaagaagctgaacagcttctgaaaaacagatgggagatttctgcactcttgccaaactgagtaaacaacaacaacaacaacaacaaatcatttcacagcctaccagagagaataatctaagtgaataaactaagttttactacaaaagttgtaggtgggttcaatgaatgagaacaagccagaagtagaaaaaaaaatcatatcaaagctgtaactgatcctaacttagctcagcccctgattaaatcaagccatcactttactcactctgtcttcctggccaaaaaaaaaaaaaaaaggtgaagcttaaccctctctgcaagaagataatatcatatggagaagccagagtgacaaaaatttatgaatgacaaacattcagttataaattaccagacaggcaaaaacaagaatacatgaattttaaaaataagattaaaaactgaaagaaagaataacagatgataaatacattagaaattaacaggcaggaacgtctaagtaaatataattaatatattaaaagaaatagaggaaaagagaaaacagattaaaaaattgagaatttcaccagcaaattagaatatgtaaacataaataaataataattttaaaactgagaaatataataattgaaatgaaaaccttcaaagatgtgtctaaaagaagactagacagtagaacagaggataataaactggaaaatgagttaatgaaatcaggcaaactgaagtacagaaaaaatgaaaatacagacaagcataagagaaatgtaagacagtgtaaagatataataagcatataattggatctcataagaaaaatacagagagaatggggtaggagcagtatttgaatacacaatggccacaaatgttccaaaaatgatggaacacatcaacagttgagttcagaagttctgatagacctgagaaggttagatataatagtaaagctgcttcatataagaacaaaaatacaatcatacaaatagtcacaataatagaaacattgccttaaaagagcatcaatacattcataaaagaaacaataaaaccaaaagacaatgaaacaatatccaactgatcaaagagaatcctattcccagagaaaatatcctttgaaaattaagatgaaataaaaattttcacataaacaaatggtgagagaatttgttcctagctgaactaaactaaaaaaaaaaaatccgatagaagaaaaattatctcaacggaaaaaaatgaagaagaaaatgaataaaagaaggataagtatacaagtaaatataagtaaatatccatgttagataacaatcatacttatggcttgggggatttacaatgtatacagaattataatgtatcataacaacacaaaaggcagaagtggaataaattgagtcaaactattccaagatccttacatcgtctgggcagtgagaaagtaataacttatattcaaatacgcatgttttaataattatccacaataagacaaaaaaaaaagaaacgtataactaacaacgtagtagagggaaaatggaatcgtgaaaaataattgattaattctaaagaagataagaaaagacacaaaaaaatataaaacaggtagattatatagaaaacaaatagtatgctaatacctatcaaagccccatcagtaattatattaaattaaaagggattaagtattgagtaaaagattaaaaaataaaacctaactatgctgtttattggaaacatatcttaaatacaagaacacagaaagccaaattgtaaaaagatgtgaaaaagatatactataaaaacactactcaaaaagaagctaggtattacattaatgtgagacaaactagatttttaagactagttaaatttctagagaaatgctgataaaacgtcaaactaacagaagcatataaaattataaatttgtatatacccactaacttaacatgttactatagacggattatagatagatgatagatagaagatagatagatagatagatagatagacagatagatagagaaaagttggcagaagaaaaaagagaaacaattccaaaatcactggaaagaatttaattcaccaatcttcctagacaataaaacaaatgaacatgtaagaataaagaatatctaaacacaacaaataacttattgtcataaattgaccagtgcatacaaatatcataaaatgtatattatctttaaatgcatactcaatatatactaaaagctattattagcaaatgttaactaactgaataattcagagaatatacacttggccactactgaattaaattgtaaaataatagcataaataactataaaatctccaacttttggaaattaagcaatatacttttcaataatacatgagtgaaataagtcatgatggatattgaaaatcttatgtgctaaatagagtatgatacagtcagtgtatcaaaacttttgaaataccaaatattgtttctaaagacttgtttacagccttaaattcttacattaaaaaatgaaaagagctgataatcaatatctaagattctatctcaagaagcaaaagaaataaacagcacattacacccaaaaattagactgaatgaagtaataaacagcagaaaccgatgaattacagtagaaagcaaacacactacagagaaattgaacaaaacacaaaattgctttctgtttttgaagattaaaatttctaatcacttacagggctgatcaagtaaaataagagaaaagccacttgccaatatcgggaacaaaataggtctgtaggtcctgtctgttgcagaaagaaacactctttcaagttgacttcgccagtgaattcttccaaatattaaggaagaaataatgccaatccagcataaacccatccagagggttaaaaaacaggggaaacactttccgttctttttatgaggccaatataaccttggtatcaaaatctggcaaaatattacaaaaaattaatatcacacattaaatcaacctgtttcaggaatacaggtgaaaaaagttcctgaacaaaatattagaaaatcaaatagaacaatatattaaaatgatgggttttattgcatgaattgtaatggtgttttaccaataaaaaatagattaatataatcgacatgaacagaaaagatgaataatacataaaattatatcaatagattacaaagttaaatatcatttattttaaaaatcctattagtaaggtaggaacagatgaggtcttctgttctacataagagcttcagataaagtgtctacaaatattgtagttaattgtaaatcgttgaaagtattttcagaaattgaaaatgagacaaaagtgtctggaggtctcaactagtgcagaaaggcatgaaaaaagaagtgaaagggagaaggatgttataggcagaaataaaaccatcatttttgaaatatatgattacatatgtagcaaatccaaaagaatatctagacaaattattgagattcacaagtgactataacaaggtcacaaaatacaaggccaatacaccaaaatcaattgcttatccatatcgtagcaagataaaagataatataaaaattttaaatataacttttataacagcataaaacagaagctattcagaaataatttaataaaatatgtacaaaccctgtgtcctagaaactacaaaactttgtggacggaaattatagaaggcataaataaaagatagcatacaacatgctcaagagttgtaagaaataacagtgtataagatggtcattctccacagaatgatctatagattcaatgcactcccaatcaaaatcccagacaagttttcattctggtggaaattgatcatccgattctaaaatttgtatagaaatgccaagacctaagactagccaaagcagtcttgtaggagaaaaaagcagaaggactttcattaccagttatcatgtcttattgtcagactgcagtaaatatgacagtgtgatattggcaaaaaaaaaagaaaaaagacaaatagacaaaataaacaaatgaaggtccaaaaagagacccacattcatttggccacatgacaaagatgacattgcagggccagggggaataaatgttactgattccatttaatattcatacagaaaaattgcaatttttgacaactacctcatgccatacagagaagtaaatctcagaagaattgtaggccaaaatattaaaatgaaaacaaagagattaagaatataaataatggattttttgttggaagaatcaatgatttattaatcaggacacagaccacactagttttacataaaggaaaaaatgataaaattgataatagagttaagtgtataagttttattacagtaggcttaaggatgttcaatatttaaaaacatagaatcaaaaccaagacacagtggtaaaaaatatttacacacatagacacacgtaaaacaaaagacttatatagaataaactaagaacatcttcaaatcaattttttaagtatataatccaatggaaagattggcaaaggacttgaatagacaaatcacaaaatattatatccaaatgaccaatggctgtgatacaagaagctcaattccagtgatcatcaagttagtgaaaattaaaaccagattgacatgcctactaacccactcatataaaatgaaaaatacagataattctagtgttggtgaggatgtggtgcaaccaaaaccttctgtagtgctagtgagaatatgaactggtacagagagttttgggctataagataatgaccctaaccttgtagacaatggttaaacagtatcttctgaagctgcatatatgcattaccaacaattccactccttggtatatccaacagaaatgagtaatatattcacccttccccaaaaacaaacattctaatgatcacaacatatacttatgactattcatttcagcaaaaagctgggaacaacccaaatattcatcaccagtagaatgagtaaatcaactgtggtatatcacataatttaatactagaaagttatgaaaataaacaaactattgctacctgcaccaacatggataatacccaaagacataatgttgactaaaagaaaccagactaataaacactgcatgactatattatataaaaatcaaaaccagccaaaacttatctatgcttttagaatttgagatagtacccttggagttattaaatccttgaagagaacatgaagagtaattctggggtgctggtaatgttctagtttttggtctggaagctgggtacacaagcatgtttactttgtaaaaattcatcaagaaggatacttatgactatgcttttattttatgtgttacatacatcaaaagattactaaagaattgaaaaaaaatttctcagaaacgtttcccaccaaagtcttgataacatactgcattccactagttttaaataatttcaattgttacataattttctttgtgtactatgtgaatttaaactgatgttatataactgctaagtagctatccgtacagcacttatcataaatcttttctactgtttgaacatgtactttatatattttaatcattttttataaaagggatttctattatattctatagttgtatatttccagttttgttcagtatcttgttgttttatttttggtcgattttaaaatagacaactttcagagtactccttcatcagtcttcatgatttgcttatattctctcgtgtttattttttcacatgaattttatccactctattgaaataattcttttctttcagctatcttatataaacaaaaagataaaccatcaaaacttttcatgcaggatttgacccaatcatattagtgtcataaaatgaatacattgatatgaataaagactaagtatggaagcacattttaatattgaagacaatatgtgactagcacatgagatgagcccaagagtaggaggaataaagagtggtaaaacacccatgaaaagttcatgaagtgtaatcggtgatcaaataaatatgaagaacatgagagaaggagtaattaagaataattccatcttgaagtatttagcagatgttgatattaaaaggtctagattttaaatagaaggagagagatttgggctataagataatgaccctaaccttgtagcatttacctctgaattgcccgtcagatgcccaaagaaaatatgacctggccaggcatggtggctctcgcctgtaatcccagtactttgggaggccgaggcgggcttatcacctgaggttaggagttcaagaccagcctagccaacatggtgaaaccctgcttctactaaaaagacaaaaattagccaggcgtggtggcacataccagtagtcccagctacttgggaggctgaggcaggagaatctcttgaacctgggaggcggaggttgcagtgagccgagatcgcaccattgcactcccgcctgggtgacagagtgagactccgtcttaaaaaaaaaaaaaaaaaatgacctagaggagatgaggcttttttttttttttttttttttgacagtgtcttgctttgtcacccaggctggagcagtgggatgaactcagctcactgcagcctgaaactccctgggctcaggtgatcctctcacctcagcctcgcaagttgctgggaccacagacacgcaacactacacccagctaattttttgtactttttgtagagacggggttttaccatgttgtccaggctggtcttgaactcttgggctcaagcaatccacccgcctcagcttcccactgtgctgggattacaggcgtgcaccaccaagccctggctaagctcttttcttattttagatttgagagctattagcatgcatggataagaaaaaccattgaaattactttttcgcaataagggaagaaaaaaagacacacacaaaaaatcaaatttaagcgttggttagtatcttaattggctgctacttgtagcattaaagtaacttcctccaaggcaaagtgtgcaggaatgctctcaaaaacctctccagctagggcccaggttcctggtctgttgccttggttccagtttcattatcttagccatcaaatggacgtgttgagattgttttacttgattccaagcttacctttgcattcttcactttctaatctttctctactctatattctaacatctctgagtaactttcactctatccctataactagagctttcttccagagcaccagcccaggaattgccctcagagcccctcctttgcttggaagaaaggaaacactaaggtgtccgtgaagcagacagaaaaccagcaatcagagaagaaccccactggttaaatgggcactgcttttctaattgttctaattgtcttgtcacttttgtatcaccaacattttcccacattggtgaaaactgatcctagatatactcacctggcatcctagatattgctctcctggcattcttctgggcatacatctattatcaaaataattaacatattttcagatactttgccaagggaggaagttctgactgttgaaattcctgtttaacactatgctttgacttcgtgatagtcttgtaatgtttatcagaatagtgtcatctgaactcttcacaaaatcctccaatggtttcactgcctttgtccccttcccttgtttctctattccctttgttcctttccaaagttcaagaatttccacttgtacccacaactttataacatacaatgctattctcaacccccttccactgagcatgttttaaaatatatttaaaacccttttattctctcttctactattgaattccatctcatcaagctgtgtccataaaacttttttaagtttaacatttcaaagtaattcttatattaaatacgaaatctggaacaattagctttctggttgtttttctttttcctttcctttattttttacattttttacagtagcttcatttcacaccccttcagagtagaactgtgagaaacttcattacctaattggcattttgctgcatgatgtaccgcccataagagaatcagttttagaaattacacaacaaatccattctcactgaatttaggcgaggttaaaaaatatatttttcattctaaaagtattcatgaagggataaatgttaaaaagatcaattccataataaggagaaaatgtttgacatctggttagtgggaggggggatgaaaataagaaaaaaactagagatgatataacttctgaatccttacaagttttaaatattcgaaacctaacataatgccatcttctcttctctctgaatttctctctgtctatgcactttttcttcttcaaatcctttaattatagccctagaccagctgcagtagtgcggactgtaactatgatttgctaacactctaagtttcttggtttgctgcaactggctacctcctaaaaaagattggacttgcacctcagctctcagataaaaagtaagagcacttgtactcagatgaaactgagtataagcagatccaggcggtgcagagatggactgtactaggctcagtttatgtgctacctgagttctgcctgaaaccaccttcatcacgagacctcagccacttgcctctctggtagagcaagagaggcactagtgaagactcacaccttccacagctgtgatgtcctggatactgccactggtactgccacctccatcatcacagatttaggagcctccacacactgcatctactgacatagggacacagaatctacccattgactgtattggtcacatggaggctttgacttctccaacatatatctgaaggggcaagataatacacccagcatatggtggcattaatgctaaatgaatagactttaaccaataaaagggagaaaacagaggggggcagaaaataaatgtttgccatcccttcctgtaattattttttataatagtttcatatagcctctctggagacttcctacaacaattagcaatcaactgtcatgcaaggctgcgaaaaaaaaattcaggaacatactccttagtcttaatttttcctttcctcttgcttttctaaaattctatcctcaagaaagttgtaacacatgaacttttgcctcaaggtctgttttccagatggtccagatggaccttccagcttccatcttccagaagcttatgcaagatgggctaactatcagcaaaaatgatattttacattggctattctaaatgatgacaactaaaacctaaggatatggaaaatttgaaagaagtatgaaaatatatatagcaggcaaatagtaaatttttaaaactactgtagttctattaaatagagataaaatagattttaaggaataaaaactgtaagtaataaggtggataaatactcaattatataaaacaaatttaccagaaagagttaataattattttgtgtgcagctaataaaatatcatcaaaatgtaaacagcaaaaatgactgaaacaccactaacaaagtgacaaattctcaatcacagggagagacttcaatttacttcttttaattgttggtatgttaaccaggaaggaattgggaaatataaataattaaacacattattgaaatatttctaatagcaatttttgaaaacctagaatgaatcaaaatatcatttgactgatgacttgaaaagttgtatagtcactcagagaaatattatgtagccatgaaaacgaacaaattacagctatgtgcaacaacatgatgaacctaagaaacacagtcttgagtgagaaaagcatgttgcagaacacattgactatgataccaaactatgaagtgcaaaatctagagataaattcatttgtaatagaaactattttcaaaagcaaaggaacaataaacctaacatctaggatactaattgagttttggggttggcagagggatgggatttggaggaaagcatagatacagcctcagtgatattcgtaatatctacctcataagctggttggagggttagtgaccattttattttcatgcttcattacttttatgtaagttgcacatattatttttatgtattaaacattataaaataaaataatatgtaaaatttaaaaattgattttaaagtatatgtctagtaagtagagcaaggtaaaccattaattactgaaaaagttatttacaaaaaatgaattttaccaattttgttaccaagctttacttacaacagatcttgaatttggtctaagatcgtactgcactgagtttcctagattctccgtcaaaagaactgtaatttaaaaaacgataaacattgattcaatttaatgagctgctttccaattttactacatgatttctttcaatatggaagggctttatggtaatgtccagggaaattcggcatgttttatttaattgtggtcagaaatgtaactataattttgaaactaccagtgaaaatgtgctaaaaatgtatcagtatagaggaatgccagcattacttgatgtcatttaaatattcttccttgaattaccatatgctatgtatatatactgtatactgttacataccccggtcctcaacctgcaaaccattagtatagtcagcacacagagcgacaatgtaagtgataaccccagagaacatgaattgctactctgttcattttaatgctacatacagctaaatgtccatatacagtctatatctcaattatccacatgcgttgagatacgtaatgattactggcttgttcccaacagacttggatttattcacttattagctgtgggaccatggcagttttattattgctctgacatattttctgcattttaacaaaagtgatattatgactccccaatttagaggtctgtagtgaagatcaaataaagtaatatatgtaaaattcatagcacgatgtccttttcattcattgtgagcactcaataacagtaagctgttgtcatcatcattatatggttgggttagtgctcacatccatgaccagcttctagctcaaaagaaacactgttggtctgttatttttcctaagactttggactagccagactctataagaatatagagttcatatatatggagaatataaataaaagaatgatgagtgtatgaatttcagctgcaagaaatagaagacccaactaaaagtgccttaaataataaagaaattttattatgtcacatattaagaattcttttatagaggtagggtggtatggggttcgttattcagaagctcatgaatttcaccaaaaacctgggctgtttctatctttattttctgctatcctcagtgtgtctgttagtctccccagacttgccaaacggctacagcaacttcaggtaagcttcatataggattgttcaaagattgtctgaaaagatatctctcccttttgtctgaagactatggaaatgtcttcctagaagatgttgcctcatgttcagtgatcacaattgcatctcttgtccattcacagaagttgggagtggaaaggctgttaaggataggtaactgacagtatctgttacacggaggatgagaagtaggtgtcggaagtagcattgaaaaggttaatcgatcaacaaataattactgtacagtatctattacagagaacaattctatgaatatgtgagaaaattaaaaaatgaagatggcaatatgcagttgagaaaaataaatgataatttttatgaaaaagcaaaaataccagcagggacataaaattaagtaaaataagaaaaatttacagaattttaaaacaatattatcttattagttatgtatagtgaatgtcattattctaggcatatctcccctttatctttaattacatttccctcaagggaaataacactcattttattttcagtattagcataccacatggcttagaatttttttttttctggttgttacctggacactaacattttaaaaataaacgagaaccctagaaaagttaaattatctgcattacacaatttaaattcaagaggaaaatcataatgataaactaagcacttagcatgcatatataatattgtgcttagattctcaggcttactgacaaatgatcagtatataaacacttacacaaacaaggaagtaaattacacttttgttcaaagccatcacagaagccataaaattcctccctgtgcatttttgaacttgaaaatattgatgatttatatataccatgtattaaatcaaaatagtcatcaagagagtgaccagtaaatatttaatggatttatgaacattagacctattatttttaacttgtttccattatagttaaaaggaatattgaaaaaaaattcacagtggtgttttctgctgaagacatcatgtttttaaaggctctgaactcataaaaattttaaagctaatagcaaccttataaattatttcatcctgcctcctaattttactaatgagatccaggtagatagaggctgacagacttttttttcaggtcatttagttggttaggtgtttgctaggactggcttcccctctttgcagcctgcatttggacctttttcacaggatttttctattttcttctctaatgttttattgttcttgattttttctctttcactgttagacaaataacatatattaatattttacttaaatttaaacaacttcttgtagaaatataaccacggagagatgaattttttttcaagtcagttgtactctaatacctgtgaagagcatttccttcatagctgggaactctaaataccagtgctgtttctcacaaacaccccttcctcagtgttatccaaaagaatatttaataacataaaagaataagtaccataattatattactgaaaagaaaatcaaagtgtttcaaagtccctttcccaaagctacgtatagtccctgcaggaagattggtctgaataaggactttaccttccaatccttgtccctgcactaaaatctaccacttttctttccttcaaagtaaaatgcccacaaggggacatggcccagtattattttctgaatacatctctgggtctatattgcttaagtcatctgctttatataagcacatcctttaggcagtttccactttgtctcgttactgttcatgtccatttcctatgctggtaaaatcagctagctatttcccattcagagattcattccttcgacaactatttgttgaacacctcttgtattcctggcatcctaataagctctggggatattttggtgagcaagaaagacacaatttctttccttacagagtatttagttcaacagggaaggtaggcaattagataactaagctcaacgtgctatttgctctgaaccagaaattatggagtatgatgagagcacataacagtgacacctaatacaacttccagaggaagttacttttaaattggatactgaaggctgagtagggagttcacaggcaaaacaggccaatttcattttcacaattttgttttgaacttctttatttttcaataaaatcattcctaaaataacgttttaaaatctagaagcttctcatttggaaactctgttaagtcttttgcaccaggattttgctgccatatctcgatttctgcatttccttgaactgaatcttaatatctgaattcaatttctgctgtggctgtggtttctcaaagaagggtcactatctaagaatcacttaggccaggcatggtggctcatgcctgtaatcccaacactttcggagactgaggcgggcagatcacgagggcaggagatcacgaccatcctggctaacacagtgaaaccccgcctctactgaaaacacaaaaaattagcctggcgtggtggcaagcacctgtagtcccagctgctcaggaggctgaggcaggagaatcacttgaacccgggaggcagagattgcagtgagctgagatggcgccactgcactccagcctgggtgacagacactccttctcaaagaaaaaaaaaaaaaaagaatcacttaaagtaatatttaaccttgagattatagggtcaactctagttccaccgaagtatgatctctggggcacgtgggagagtcctcaaatttgcatgattaacaagttcccttcatacacactgaagtttaggacttactggctgccatcattgaatgtatatacagaatgtaactaaaatcgtctcccccaattttgttctaattgtctcaaaatggagtatatttgccctttcatgggaaagctatctgtggctgtccagatgccaaaaactcaccttgattattttcccattacattaccctaaggcagtatgttggtatacaagcatttcttgggactaaaatgacacatgcctagggcaatcaccggttattgtagccctcttacttgggagaattaggaattagaaaggtcagtgttagaaattcctgtttcgcctacctggagttgtatatttttatctaggaaaataaaatcacagttactgtaagtaacaagcctccgaccaactcagaaaattggggcagagtttatcaaagtaccctagagtttttgacccaagatccaatgttttaccaactaaatcattctgatgccaaagtatattgtataaaaccattactttagttaggataagagtagcctgctatgaaaatgacatccattgataattcagtggcttaaggaagattcaacattatagtgttttaagttggggaaagtccttgctctacataggttttaagtgatcaaggttcctctcattggtgctcctcctttctctaggacattctaattctctgaattgtaagtcagtttgctatagattccaggtagtggagaggggaagaagagcatagagaaagcccaagaaatccatgcatgattgccattcatactctagaagtgaaaacctagtcttgtggtcacacataattgacatagaagctcagaaatgtattccctgactgggtgggtgcatgaccagttccaattgtggaaaaagggaagaaacagatagtggtgtaaaactagcagtctccataactgtactttagagatgcaaactgaatcgtaatcttttagccatagaaggattattggccctgcggggggcggccgggggggagggtgggtacggcttgtatttttttatgagcataaaaattaattcatttaataaaaaatgggacatattcccttttggaaaacagttctgtgccatttatctattgctgcttaacaaatcacctcaaatcttagtgacttaaaacagggatcagcaggccgggcgcggtggctcacgcctgtaatcccagcactttgggaggccgaggtaggcggatcacgaggtcaggagatcaagaccatcctggctaacacagtgaaaccccgtctctactaaaaatacagaaaaattagccgggcgtggtggctggcgcctgtagttccagctactcaggaagctggggcaggacaatggcgtgaacctgggaggcggagcttgcagtgagcggagatcgggccactgcgctccagcctggacttcgtcttaaaataacaaataaatcatgctgctataaagacacatgcacacgtatgtttattgcggcattattcacaatagcaaagacttggaaccaacccaaatgtccaacaacgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccgcatattctcactcataggtgggaattgaacaatgagatcacatggacacaggaaggggaacatcacactctggggactgttgtggggtggggggaggggggagggatagcactgggagatatatctaatgctagatgacgagttagtgggtgcagcgcaccagcatggcacatgtatacatatgtaactaacctgcacaatgtgcacatgtaccctaaaacttaaagtataataaaaaataaaaataaacaaacaaaaaaacaacaaaaaaacccaaccaaccaaccaaacaagcaaacaaaaaacaggaatcagcaaacatattctgtaaaggggaagaagtaaatattttgggctttccaggccatatggtctctgctgtaactattcaactctgccactgtagtgtgaaaacaaccttagacaatacacaatatcatgtagtggactggatttggtccatgggctgccaatccgcagttccaaacaaaatttttattttatttttgctcatgagtctgtgggtgataaattggtactccatttagcaaacaggtcatacagggctgaatggtctacagtgaccttgctcatatgtctggtgtttggtccagggagcctcagctggtatggttcatctccgcccaatgtggtctctcctcccagcagctagctcaagctttttcacatggcactctcagggcagcaaggacagcaagccctaatgtgcacgtgcttgtcaaacctctgctctcatcaggtttgctagtgtcatattggccaaagcaagtcagctggcaaagccagattgaagggggagagaaataaagtttagctcttgatgagaggaacagcaaagtcatattgcaaagatgtgtgcatacagggataggagaaattatttcaattttctttgtaaacaatctaccataaagtctttgaagtaataaaggacttacatttcaattcaacttcagtagtttttttttctctactagaaaattacttagatccttaaaatatttttaatgataacatgatctttacaatttataagctatatcagaaaatgcatatgtatgatattttaaaatattacaaataattaaattccaaggccagaaatgaaaaaaggatcttaagagtaattcatattgaagactacctggatgagagtttttaagtaggcaactaagcagggttatctctagactgtttaatctttccttaaatttatttcctgcagtgtctacctttaaagtttcaagttacacataccgtctgtcatcatgatagacacagtggcctctggctcagaattttctatgagagctttctgaacagtggggcgtatagctagcatcagtactcatgttaacttatcaagaagttttgaagaactgaagccatgaatttaatctaattcaggggagtgggttaaaacttcaagaagtgcccttgagcttctatatgtgtgtgtgtgtgtgtgtgtgtgtgtgtgtgtgtgtgtgtgtgtgtatatatatagagagagagaagcttatatatatcactgtaggaaacagtttttttctaaactaatcatacagaaggaatttactattcaagtattagtaactgtttatcttcttcacaaaaatctaataatatttaggagaaaccatttcatctataaaatcagtaaagtcatttttacaagtcctcctctcctggaattttgatgaactatttgaaacgctttctaggatgttagaaatgtgaaactgttctatgttctatatacaataggctgaattaaaatactacagtgttaccattattgaagtttactatgtaccaggaatcatgtaaaatatatcatcctatgaagggttttcagagtcttacgtgaacctgtcgtatttaattttacttttcagatgaaaaaaaaatccctttaggttcataaaggttaggaaacttgcccaaagtccagtggtgttctggtaagctggtacatagggaataaaaccatgattgtctgatttagtgtgccaattttagaggtgtaaataatctcatcttggctgatttcaaactaccaattatgtcactgagcacaatgttgggaagagatgcacacaatcagctatcataaaccagtaggaggtggctctgacacatgactgccaagatcacagatataataggaagtaggagagccaggatttgagctaccagttgtctacaaagcccatcctctaaatcatcatacagtgatggcttcctaacataataaactagtcacctgacaaatcataaaaaattatgaatgtcaataacatttttaatttcagaaacacagatatcttttacactattttggaaattaatacaggaaatggtttttcagaattatacaagttatatgttagacgtcaaggaaaagttttatgcttctttcattccattatcctctttttttccttaagctttcacaatttctttgtgttatttcttatttgcattttattgccacatttcatcttaaaattcttatgtttggcccccgacaaatttctttgctgttttagactgtttgctgctgctgtttcctttcttttttctttttcatcacatatttatttttttcttaccttatggcacaactttcacattttgacttgttggttcttcagcattctggtttgagcaagtaagaagatggataggaagtcttattactaaaataaggtgggctcacattttaaaaattatttacccactctgtatcagagatttttcatctataaatggggatgacataatacttaccttgtgctatataagttgttgatcaactaaaataaaacaaaacaatagactatacaagaaacacatatggaagccctgagatagggatgataccttgagaatgcataagatccaaaattatttgatgcagatacaaaaaaacatttgatgattgatagggactcattttaacaatttggaaacaattgaacttttcaaactgatagcatttttttcacaacataaataaaattgtacttgggtactttcttcatttaaccgattttacaccaagaatttttatcctttgttaaaataataaaggtactcaaaaataccatttaacattatcatggattgaaagaatgataaatgagaaaatctatttttcccaaattatcttacatgtgttaagctttaaaaaataagaaaaacaattttgcaaattggtatgaatttctatctgattggttgaggggaaatttatgaaagcatacctgtgatgacagatcaatgcatggctacactacaccagagcaagcacaaactttaaaaactcatcggaattttcataatttcttcaaatgtttgaattgaagtgagtagatacccagcaaatttttctcatatgcttctgtgaaaatataaaggtataaattaaattggtttttctttttataaaatgagtttcattgtatatttttcttccaatgtaaagacagaatatatcctgtgaaatagctagttgataatggattgttatcatggtcaataagttaaaaaaaaacttacctgttgtctgatgtgtcatttttataaatccatggcaaaatcgagtggcatcttgattttctgttgaaattactacttttattatgtacattatgtagcatatcctagagttttgaagagttgtacaaaatggtgagtaagaattttttttttctgaatgcattttcaagtacctctaggcaaataaaaaataatggataggaaatagagacaatttagaagactgaggttcaaataaattaaaaccagcaatagaagcaatatggaactctgaatcaggaaatacagccagcagtgaattcgaattaaatagtggttagttataattaaacttcaaacaaaatttgtaagtcatgtataaggccactgaatggaacatataacaaagtttggattttgtgtatttttatttactttttcttcctcagctcctaccctgacattggtgttgttctatgagaagccattttgtatgacaaacagaagatagtttaagactatagtaatgttaggggctagaaaggaatcttggggagaaaaaaatcattaactcaaaatttaaccaatatccttctaaaagatggaaagtgatgatgatggcataattgctgtctcagcctaaagaaaacaaaactattgaacaaaatacctctgttctttccaaagccaaatgattttattgactattccaatggctttacttgttaatttcatcgctcagcagacagaaagtgcaccttggaaataacattatcatattggcttttttcctttacaattaaagaatttaaatttttcttctgcatatcacattacactagacatacgtattatttctcttctaattttgttgttactataaggtgtgagcctcacttattaatacatggtaattgacagcttcttttctttattcaaggaaagaatggggatgatcagtttttgcataaaactttagactgtagtaaagtctgtttctctcaaaattctgggttacattttattgacctgtaaagcacatgacattttaggagcttgtagtaatttattttatctgtaggaaaatgtatcactgatgaatattaaatctaaacatattctagtttaaacagatggtgaaacagaagtagtgagaaagctaaataaataataaataaattaaagagaagtcaggattagtcacaaagtgaaaatgaaagctctaataatgacaaggttgtgaacaaaacatttaaagaaaatgcaagacgcatagcttggatatctaaattctatttcttcataattttcttggcttcattttattatgaaattatcaaatttagctcaatgaatataaaacatgctgaacttatgagaagtgctaccaagattatcttgcaacataaacatcagttttgtggatccttaatataacctctatattgtcaagatgttatatttaatagttctaatccttcaatgaagactactataattccccaaagttaactttatttggttatataaacaagccatttcaatattacaccatgctttttattttaagcattttatttttatattaattttaatttccagaaaacagttgataatgtttaaattgatcatttttagggaatgcatggtttgtcataagcaacataaataaacacattaattgccttgtcatacttttatctgacagatgggtccccaggcatagagcctaaccttttattttgacacctgccacattttgccagccctgacccttttttctttgccagaatgtcactgtgttcaccatggttgcactaatctccagcttttgaaaggcttaatattggaacccttctgagaatcactgctatcaatcagctgatactacaacataaagatttcacagatctatccaacatcccttctctcctgtgattcaagcacattttctcttatttctatgacctactggctcagtaagattacatggagcttgttttaatctaaagccgcatattgttaacatctgacacaaaccatttaatttagcagtaatttaaaatttagaatttactgaagaataaaaaaagaagctatgatttcatttttgtactaagagaaacttttaaactgtgaagcaaatatgctattttaatatagctaaggagttaaaatctatctgaacattttcctttttaaaaaaaaagaagcatcaagcaataaaacatgttttgaaaatcactgtgcactcaatttcatacctacacctttgatttctggggtgattccagaagccattaatatatgatgtgtgtctgggttagtgcaactaaaagcacatgtctggcccattaaagagtaggggttggttctaaaaagctctgcaaatcggagaacatacagcgggcagatgaattgtgggagctcatccattattgagataatttggtataaattttaagatatttcctccttgagcaaaatcagactataattaactatgaaaaatgttgtaattattctttttttgtgactaagttaaaaacaaagaaactgaaaagtaggtatgtaggagacagattttagtagcaaacagaagatagttccaccagatcaacacagtttggtttacaatctcattgctgagatgtggatgccaataacttgtctttcaaatatggcttctattggttctgaaataagcttgtttggcataataagaaaagcctgggactatgtcctggttaagctaagcttcttgaataattcagagacatatttgtgccagctaggatatagatgtacattgtaagaagtgtaggatctgtatcttaggacattcaaagaaaatgatgtttcatgccttgggctaaggggtactgggggtaattctagaattctagcagctttttcagcttcagcacagttctttaatctttgttgttgttgttttagatggagtctcgccctgtcgcccaggctggagtgcaatggcgtgatcttggctcactgtaacctccacctcctgggttcaagcgattctcctgcctcagcctcccgaatagctgggataggcgtgcgcctacatgcccagttaacttttgtatttttagtagagatggggtttcaccatgttggccaggctggtctcgaactcctgacctcgtgatccatccgccgcggcctcccaaagtgccgggattacaggcatgagccactgtgactggcccagcagttctttaatctttagtcatctactattaatatgactcagctgcattgcacatattcctctatctgccctgccccaatccagctttcacggattactcaaagtttctgctcgttcacattttaaccatgtcccaaaccttggaatttcatagaaaatttttttcttcgcatattatatctaagtctagagacaaaaatactgatgagcccagctcatcttttgcagcctggccacacagttcaaaaattgctggccaatctattttttggccccactccattcagctgtaaatttaaagagttagtgtttgggttgggttagcgttagggttagatcctgtgtgagtaaacatagcaatttagatggcagatgttctggatgaggatgattcttttagaagggatatgtcatgattgacacaagcaacactgaaagtgtgatccagagactggagctgttccatgtgctatttgttatccaaccaaaacaataagtacattgaaattaacaatttaggaattcttcgtcttatttttttatttttctagtagttcaattatattactaaaaaataatggttagcagcatattgggggtgggtggggagttggtctttcagtgcagatactctgagagaaactggattagaagactcctagactctaattatggcacctccttagccaattaataatgatcaaatctttatcatcaaattataattctctgaacaccagtttcctcctaaataaacaaggactatcatggcagtcactcacctttccaagttatcagtcatgagaagacacaggagaatgaattttgaaaagctgcaagaggctaatcagaattaagttataatagtttctttataaatacaagcatacatatatatccatatacacgtcacatgggagaattaatatcaatactcaacattatcataataaatatatttattttaaatcttatcactttcccatataaaatgtaagatgtgggcagtgtgggttttattgcttgtttctgttgtatttactagtttttacagaaggcaattagagagcaaattgataaagatgaacttagcactctgttctcaaaaagtttacagttaaatcactgcatacaaaagttaaataaaaatattaagcagcataactctaagaactattgagaatgaacatatttaataaattaatgatacaaatattaaagaccaaagatatccagaggaaggagagaggattcaatgctactgtggccagagaagcataggcaggatttatacaatgttttgaagaatggataagatttagaaagatggaaaggatgaatggggttattctgggtagaacaaaattttcaagcaaaagtcagaacatctatgtaaacatatgtgtgaatatgtctgtgtgtgttctgatagagaaacgtcagaaaacatatgaaattagaaatataaataaaatttaaaatcttaaaaatcatattgtaaaatgaaaatttaatttttttaaattttttgccaccaatagtatgatagtaagttattaaaactgggctccttgaaataaaattccttttgtatatatatatatttatatatataaaatttactgtcatatatgtgaaatgtaaatgttacaaataaaaagtaatgtaacaaagaattttctccaaataaaacacaatacattatgttaaatgattttttaatctcagaaacaatgcaaagaataaaaacacaattttaaaaatattagcaaactttccagtgaccttctgacatttcaatctaatgcaaagacactaactaaataacaggaattgcttcttctgatgggcaactatatgaccttagcaattttattactttacaatagagtcacaataattaaattacagaatatttcagaggattatgtaaatttggaccactgtacctacagtgcctcacttagaaaagtccacctagtaaaaataccattattttaagaagtactgtgatattaataatgcaatctagtgatttcaatacaggctttcagtatttcagcattcaataatgtcatattaatttgaagtccaaagtactggtaattttgttagtataatattgttttattattctgacatttattacatcatacaagtaaaatgaatgatttcattgttcaatttatacaaaaaagacaaacagacaaatggtccacacataataagcaaacatactgtggtgctgcaaacttgttttgcaggaataagcctactctgatggcacatgtgttaagacagtgttgatagggagagcggtaactctgcataggtatttccaagtacacaaaacaaaagacggtaaatacaaactggaaatgttaaaaaaaaaaagaaataaaaattatgggtctaactgaattaaaaatattccagttcttgaaaagaaaaaaaggtagtaacaaagatcttgcatttatgaaaaaagtaggattatctgaagatgaaggaatcaaaggaaaatatccagaaagagtttacagtgtcctctacagcgtttccctgagcagtgtagatgttaaaagaatttctggagcagttagaaaaattacaacaaaatggagcaaatgaagctttgcttctttacatcacaaatctgtaaaatccaagaatattattttgctttcaattatcttaattgttttttccacttaatctactattttgtttgctattttaataatactttaattgactctgaataatttatactggaatgatgtttaatattcccatactatgtactataattttacatttttgctttttgcattcctccttgtaatatattcataaaagtttgtgtttgacatgtatgaaatatttatttatttttatttttgttatactttaagttctgggatacctgtgcagaaggtgaaggtttgttacataggtatacacgtgccattgtggtttgcttcacccatcaacccatcatctatgtttggtatttctcctaatgctatccctcccctaaccccctcaccctccaacaggccccagtgtgtgatgttgccctccctatgtctgtgtgttctccttattcaactcccacttatgagtgagaacatgcggtgtttggttttccgttcctgtgaaatatttagttagctttttttcattgcttcttgataatattcatataaactaccagaataaatacttacatggtttggacaaatagtggaggttattagaatttgaaaaatcagtaatttaaaattcttatacataaaaaaaatcactggaggtttttggacatgaccagttatgttttgcaataaggaagtatgtatagagagtcaagttatatcactgtatttatattctagaccaacattaaataagactataagcacaaagtgagaatccagaggaggatgcagatgtaaggaatactgttgagggaaaacccacacaatttgtcaactcaagacatgtgggaaggagtcagcgccaggctaatatccaagcttagttttctaggattgtggtcctaatatctaaggactaggaaaatgtgtggagagagaagagagaagcttttggatgtgttgcttttgtggtgatggtgagatatcaggttggccttatttttttcttgtatatcttttaatacagtatttcacctgtcttttcccccttatactagactctcagtcacttgagaactagggctttgtgttattggttggtgttcccgagatcttcatgtaacatttaattctgtcatcttaatatatatgttgtcagggtgaatgaacaaatgactaaggtagcttttactgaccatgtctttatccctgaaattctgacatcctagagtaggggatcttaagatcaatgctaataaagctaataaaaagactagaatgttggttctcagccctggatgcacactggaatcactgggaggattctgagaaacactaatgctccacctacagagattctgatttaattgccctgggtgggattcactaaatggtatttttaaacgttcccccagacaatttgaagtacacccaaagttaaaaacttttgagctacagagtaagtgtaggctggggaaacttgaatttttaatttagtttaagattaattttcatatactatatttaccccaacaatcaaatccacccaaattaatcttctcactgtctctatgcaatggaatttaatacctaatggataatgtacatagaagaaagaattgatcttaatagaaaatttgacttttaaaatctgtatgtaattatctgagattagaatattcaaaaagaatatgttgcaggaccagaaagcaaaccatcataatttatgcctgggatttttattctattcatgcagttatctattcatttaaccaacatttatattcaattatgtttttgttggctaaaattggaattttaattagtaccaacatgattccaaatcaggctattttaaattttagaatgtattgatccttaatacgcattaggtgattattaacagtattgattatctggaaccctggtaagaccttcaaggtcattacggattttaaatcctctaactatgctttaaagagcattacactgcacttactgacttactaagggagtggatccaattgaagtagacatttctaactttaatgttcttattattttgtctcgctctctctttaaacacagatataacacatatttcaaagtactttttacattttacatctcaccaaacagccaatcaatattaactaatccttcttgttttagaaagtaattgaatggttttaatatcaaatttgttgactcagcaatccattaattcattttggaatattaactgatttctttttccttcataggttcctgaagtgaaagaagaaagtatttagttttttgtttttttgtttttttttttctgaaacctgtttcaaaaaatctgaagccttctgggaatggaaaggactcagactatacgtaaatatttgagagggcagttccttaaaatctaaacgtgtaccactctcctacccccgcccaggcttgctgagtgtacagtaggtagatggagatggaaaatgctataaacaagttctctctctctctctctctttttttttttttttttttttttttgagatggagtctcgctcagtcgcccaggctggagtgcagtggcgcgcgcgatctttgctcactgcaagcttcgccttccgggttcacgccatgttctctgtctttagaaacatacaagggatggagtaaagtgagccacgacaaagaggaaatcagccaggaataaggactatgcaatagatgattgcaagcatgggcgtgagagccaggcagcctgggttaaaatcccagctctgatgctcaccagctgtgtaacccaaagccagttattattgttgtctaattttcctaaactataaaaacgggaataaatggactgcccacctcattaaactgttgtagggattaataagttgtgggtgctggaaagaaatggaatcttaccaaatctcccatctccccacatccttcacatttttttcctccctgggtttttaagatcctgcctcatccttattccctcctaccactttgattattcttcaaactcagcttgtgcaagaccactgtctttaagagctgtcttctggacaactctcagtttcatggcatcctatgaagtccctaccacctgcttaagaaacttcaagctttgtctcatactgtctaagctgattttttttcatatttctttgctcagttcctttagatggaccttacacttggatggctgactaggcttttgatttggcatatttcttctcagtttttcattctagcaccgcagtgcttgctgtggatgactgatactcagccctctgcactggaccaggcatcccagattctgcccaggccccaggtctggaagcctcacttttccccttgggatgatcacacagcctccaaactagatttccttctagacaaccactgcttaaaggatcaaggaccctctggttttcttattccccacattcacccaatctccttttcctccatgatttcaacattcataaataggctaatggaaataataatttaaggttgattgagtgctaacatgtaccaagcactgtattgagatagatagtattatttccctcagtttgcaaatgaggaaactgaggcacagaagtggtgggtaatataatcaagtcacaaagcaaaggaaagactgacagtcccagtccctatactggtgtatactgagtacgaattttagaagcagagtcactgggtgggaatcctgcttggtttgagatctgcacgacctaaggtaaactaggaggtctgtggcttggtttctagtttgtaaaatggggataattatgcacatctccaaaagtttgtttatgtgagtattaagggtactagcatgtgctgagcaattagtacccagcacttagaaagtgctttaatagttattattattattattattttgttttgttttgtttttttgagataggatctccctctgtcacccaggctggagtgcagtggcatgatgtgagctcactgcagcctcaacctcccaggctcaagcgattctcccacttcagcctcccaagtagctgggaccacaggcgcatgccaccatgcctggctaattttttgtatttttcgtagagaatgggttttgcaatgtttcccaggcttgtcttgaactcctgagctcaggcaatccacctgcctcggcctctcaaagtgctgggattacaggcgtgagccaccacgtccagtctatttattattattattactgtatactgcctctcatgatgtccaaatcactatctttgttctgaatttctcaagctccaggcctatttatccaactctactagacacctgcatatttcataaatgtctcaactcactattatctccctaacttattattctagtataacttaccttggtgaatatcaccatcacaccaagcacagaagtcactcaaggctcctcctttttaatcaattaacctcagacatggattttccccatattttcccagccttatatcttatccatcttccttctgctcaccgttacctaaagcacactaaattccagtaattttgaaatactgaatgttagttcatttcataaaaaaaggaaccccaagggaaccctactatatgctaggcaagacactgatcatgcaaagatgaacaggacctaatctctgccttcaagaatttcacagtctaattaggaagacaaacacattaacaaacaattgaatacaatgtggcgagggcttacaaaacatacgccagtgtattaaaggaaagtagaagagagtatggaccacctggtgaaaaaggcaatatcagagctcagtctaatttgacaaacaacatggtaccaggctctgtgctaggtgctgggggtattgtttatgacttggagaatctatgggaaaggaaagcatcaaaatatattttaatataaagtagtgactgctaagacagagggaggcacagcatgttctcagaatgcaatcaagatatttgtagtttaggaataagaaacttggagaataagtcaggaagtttagtgattgttcatacaacttcctctgcttgatctgacttctctcattttgttttcctggaaaaacccgtgtctaagactccagttattaccttcagtttgaagctgatcccaagtgcttttgatcctcaatgtcctgtccaccccaccccaccctcagcattttgtctctctttgaccactgatctgtgagagcaaatgtaacttattttctcagcttaattatttacacagccatttcctctcaatctattatcaagtgtgttgtggagagtttgccgtaaaaaaactcatatttcttagagtaatccaatgaattatcacattattgttaaatcacttgttacgcatattttcttcattgaacatatgagcatttccccagtgtttcctatatgctgaacactgaacaatcatacctactagagctggtgagctctgattcatgtggcatttttgtacaatctggaaaggaactgtattagtcagctcagcacaaaatactgtagactaggtagcataaacaacagaaatttattttctcacagtttcggagggtggaagtttgagattggggtgccagcttgattgggttctcgtgagccctcttcctggcttgcagaggctgcctttgtgctgtgtttccacatgacgcgcgcgtgtgcgcgcgcacacacacacacacacacacacacggggagagagagagagaaagaaaaagaaagagagagagagagaactcgcaagctttccgaggtttcttataagggcactaatcctgagggcctcactctcatgatctcatctaaacccaattatcttacaaagaccccatctccaaataccgtaacactggaggtaagggcttcaacacagaatctgagcaggggatgggaggacagttcagtccagagcattccacccaagacatcacccacatggatttgcaggatagccccatcctttccaccctgtgggattgccagccccaccccctagctctgacaggcttgagtcctctgagtggttctgcctccaaagagctgagtggagactgtccagcctgttgaaactgaggctgtggctctggctatctctgaattgcctttggggccattttttcctctccttgaaaaatagtgcaggttcacagccaaataagcaaatcagcccatcatgtctaacccaagaagtctcgaagccttcattctttttgtcccatcttcatccccttcagttcaaactggcagaatttctgctcacataatctcataaactcttatcaaatggttgtccagtcacactcctagtgttattttcagagcaagtttttgtcattttttaataatgtggataagctgagaatttcccaaatcttcaagttctggttcctttttgctgaacaatttcttcttcaacttatctttttttttttcatttcagcagaaatggtcaggaggaaaccagctgctccttcatcatattgcttagaaatgtcaaatatttaatttcatcactcacaagttctaccttcctcaaaacactagaatacagttcacctaagttttttgccactttgtaacaaggatcaccgtccttccagtttccaataacatattcctcaattccatctgaggtctcaccagaatcacctttactgtttgttcatatgtttaggatgcacctgaaaattcttgagcctctactcactatccaattccaaagtcatttccccatgtttaggtattagttacagtagcacccccatttcttggtaccaaaatttgtcttagttcagggtgccataacaaaataccatagactgggtggcttaaataagataaatttattatctcacagttctagagaataatgtccaagattacagtaccagcaaagtagatttcactctgaagcctcttctgttttctcataggtggttgttatctcactgtgtactcacatgacctctttgtgtgcctgtggggtaagagggagagagggcaagctctctggtgttttctcttttcagggtactaatcaggaaggccccacactcttgacctcatctaaacctagttatctcccaaaggccccatctccaaataccatcatattagagattaggcttcaacatttgattttggggggacacgattcagtccaaagcaggtgcccttcctcaagacagtttatgtccatctgtaggcaatttgtcataataaactaattttaacagaacagggtgttccactgttatctgccagaaaatggttgtaataaatacttaaatctgcaaattgtaccatgtgaatgctcctctggagttacacagtaagcaacctgaacaattattcaccgtagtccaggttaatccttccttgtcctcaactgacaatttttatgtatggtaaggaaaataaatgcttcaaaaatctgttaaatcagaaatcagaggtttagataagtaaactatttactccaaaattattacaaagaaagaccatcttaataagtaaagaatgtagtatatggtttcaatttgacaagacacaatagtgtgtgactaaaaaactgggctataaatagagctttttgctaagtttgagtacagtaattattaagaaaatccgttatttaataaaagcagctgagaacctgtcagattcaaaatcacaaggttgaaattgactaaataggtccatatgtttgtaatcctgtttccagaaaggaccttccttaaatcgcccaaaataaatgaataccttgttaaatacagatgaacaattcatactataaaatatcttccctaaatttaatttcaatccatggtacttaaaatttaacttcgtttctcttgttctgtcaatgtctgaataaatgttgcagcaaatatgaagtgcctagaatgtggcaggaactctgtagatggcaaaacaaaaattaattcatgtagaacccttcttattaatgtatttagaatacttttcaggcttccttcttttctggcaagttacacttttaactttgtacaagcaaatatgaatcatcaactagttgattatacagtctgaaattttcttcttcaaatatgaatacagcagatcataatcttaggtttctattacaacacatactgcagacatgcaagatttaacaagaaagtagtaacaatgtaaatagcattgctttcaaatctacagaaaatggctttctaagatttgtgccaatcattcatttttaaaaattgggaatgctggccaggcgtggtggctcacgcctataatcccagcattttgggaggctgaggcaggggaatagcttgaatcctggatgcagaggctgtggtgagtcaagatcacgtcattgcactccagcctgggcaataagagcgaaacaccatctaaaaaaaaaaaaaaaaagttgggaatgcctagatttaataatttgaggaaattttttaaaaagaaaatgagcagtgccttttcatcaccatgggctccttttacctattctctttttcttaattatttcatatcttctaatcttttctcaatattttacaataattctttttccattcagcttatctacacataaaagtataacacataagaatttcccacaattatcttttctttctttccttcagattatttcctttgtcatagattattttagatatattagagaacttaatgtgtttggattacttcaagaataattgtacattggcccaattctgtattgactggttttcttcagttttatgtagtcctactaaaagcagatttttaaattttagttcttaacatttcatgtgcagaatatttgtgctatttcatggtagttttatttttaattatgttggcgtattttgtgtatttccagttttaaaattgtatagaaaaaaggatcctcaaccactgcactatgagagtaggaggggtgctcttattttcctggctcttcgtcacagccttccctcaggaatggaaatcatggtggcataactggagagcagctcatcaggcacacaagcttagggaatccaagggaagaatgcactggttaattgtgggtcagcatagaaaagaacatgatcatgtcctttgcagggacatggatggaactggaggctattatccttagcaaacaaactcaggaacagaaaaccaaaagccacatgttctctcttataagtgggagctaaatgctgagaacacatggacacgtagagaggaacacacactggggcctttaagagggtggagggtgggaggaggcagaggatcaggaaaaataactcatgggtactcgacttaatacctgggtgatgaaataatctgtacaacaagccctcatgaaacaagtttacctatgcaaaacaaacctgtacttgtacccctgaacttaaaataaaagttaaaaaaagaaatatgataattttcttaattgcatggaaatgtagtaagaacaaaaattcttaaaaacgactaaaatttatacttctatagcaattaacataaacattttttaaaccattcatcagtttattttcacatacccccaaaagattcaaaaagcgttagtcacacttaaatgatttgatttttttaagtgaatcaaacaacttttttttttttcctgattgcatgaactgaccaggtgtttgatgacttttagcagatgttgacaatatattgatattactaatgccaacacttttttttattttttatttttttgagatggagtcttgctctgttgcccaggctggagtgcagtggtgtgattttggctcactgcaagctccgcctcccgggttcacgccattctcctacctcagcctcccgagtagctgggactacaggtgcccaccaccacgcccagctaattttttgtatttttagtagagacggggtttcactgtgttagccaggatggtctcgatctcctgacctcgtgatccaccctcctcagcctcccaaagtgctgggattacaggcgtgagccaccgcgcccagcctactaatgccaacacttttgataaaatgttgaactgaggttattataaactcacctttcaatttctcattaaatatgaaagttcatacttatttccttgtttcttgaaaatattctttcaaactatgccaactctctcgaagtggaagaaaaaagcaaatttacttccttgactttaccagatgccatgttattcaaaagttgtttttctttttgttttattttgttttcagggaaaaacccatcaatctaagcagtgaaaaaatggaaagactccatgatgttttttaagtatagctacaacataaatgagagttattaatctgcagcacaccaatccaactcctaaattacataataaacaggttttctgtcacatatagcctcttctctttgttaacaccattataatactgctaatatctataacttggaaaacgaggcatacaaggttaggatgtctctgataaacaaaaaagcttttaagatggggccttcattgtttgtgaagagctaatcattcaacaattaaatgtttgacaagtttgacaacctaaaactagacaacgaaattgctgcttaaaataatagaaaacatccttttaggggaaattggtaaacctcttctaggggaaataagacccattttcatgtcagctgagttttaagttgccattaaagtgataatataaagggaaaataaacggattttgattacatatttaacgttaattcaagtgcctcttgatatctccccaaattagtttgttaaaaataaaattgcctgttgacaatctatttttataaacatttaggttatctgtaacttaattgtagtttttacttaagccataacaaatagtgtttgtagtacaaatgtcatttatatcccaaaatttacttagatttaaaaatattttttaccgatttatttgctgtttcttcctgaatcatattccttctttcttgatttatttatttcttaatgaaatatgtcctttagtattttttcaagtgaaagtaggaaattctgtgtcattgtgcatctttaaacttctttattccaccttctctcttaaatgtttaacttttcactgagatttatcttgtcagcacattgaagttactccttcattctcttttggtctttcctaatgctgatgaggtcttctatccacctgattgttcctttgtaaattaccttttatctctatttgatttcaaaattctctctttgtccttgatgttctgcaattccactacaaagtgactaggtataatttgggggtttttgtctatttaaattttcaaaataattactcattgctttcttcagttttcaagaaaggtttcagccatcatttcaaatatttcctcttccctatcaataatattatttgttactggaattattagacatatgccagggcttcttgatatttttttccatgccttttaaatttcctttaatatttttcttttctttttctctctctgttgcatttttgtatgctttgatctacctattcacttatttttctcttcatctacatctagtctacatactctctattattgttttatttcaattatttgtgattttatttgactgaaatctctttttggcttacactagtgggagcagggaacacaggattctatagtgttctgaagagataatgctataagtgattcgaaagagcaaatgcctctgataagactgtaagatgcacgagagaaaggatgtttcattatctaggtagccctactacccagtaaacagcctggaaaatagtatgttctcaataaatgtttacagtaatggattaaatataaaccaagtaaatgttaaacttcacaacgatataccttaatattaatatgttgtctttagtaattgtcagtagttcaagtacagtaattctcaaaccagagatattaaaaatcacctccggagaacactaaagtgtagatccataggtcccaccatagagtttctgattaattaggtctgagatctaaatatccgtattttcacaacatgtgaagtcacataaactataaattttgattctgagagccaaagaagtaccttgaaagaaatactgtctgagtgcaatcagatttagaaatggcaatgatagaaaggtaaagcaaagattcctctacatgacttggtcagcagatgggacaggaagagactgacaggaaggaaaagctatggaatgaaggagcaaaagttaaataataggagggaagtttgagaagttctgatgctgtcttggaatcctcctgttctaaaacaaagctaccttgttttaaaaatacacaagtaataaatatttagtcatttgctctagtaaattatatgcattttgcagcatatacttttttaacttcttcacatgggttcttttactaattaaagctaattggaaataggtagaaaaggttaatattgggtctgtttccttgtggatctattttttaagatttgcatttaattctgtgggatgatagaatgataatgtaatgtaatttagcttaatatctattttgtgttagatgacagttttattaagcagaaccaataatcatcgttattcagagtcataatggcccattataaatggtctcattttccctaattttaattttacctcttagagtatgcctagaattgttaaaatggttacgcttggtttctttcataaatatcattttaacaatcagtatggaaacataagtcatctagtagttaagtcccactattctacagatttgatacaaaactattttagtgtcttggtttctcttaattaaactttcagactaacaaatttcaggaaattaaattaccatcctttatgtatcagagccttaacatcgagatgaataggcttttgtttctgggataccacctttctgactcttgtgtttcttaggatagtgatgaacagagtagacaaaagaaggacttgtccccaacaggctgcagaataattagattcacaattctctcttaaaaaaatctcaacaaactaaggtggttttatgttcataaggcattttttcttttcttttcttttcttttctttttttttctgagatggggcctctttctgttgcctgggctagagagaagtggcgtgatctctgttcactgcaacctctgcctcccaggtttaagcgatcctcccacctcagcatcccaagtagctgggactacaggcgtgcaacaccatgccctgctaatgtttgtagttttttgtagagacagggtttcaccacattgcccaggctgaactcaaactcctgagctcaggccatcagcctgcctttgctgggattacaggcatcagccaacacacctggccttatcaggcatttttttcttaaggtgaataaatttagggaacagtcagattattttctgtcccaacaattgcaacaagagacgggaatttatagaagggagtaaatggagttatttgggtcataaatacatcagtggagagagggccttagaagttccctcattttaaggctcttttgagtgacatcaaatatctgtttaaggttgcacagtttattgagcattctcacttacatcctttcatataggcctacaccattcctttcaggggaagatcactattattctaaacttacaccgagaggactaagtgtagagaaattaactcacatccaagccagttacctggtttgagtggaggcaaagcgtaagcttttttcacaacatcagagtttttacagtcagaacacatcccagaggctttggatgcctgggaaaagaggcaaaaggtcaaacaagttcaaaaaatggaggttgaaggtcatctcaaatacaaactttaccagctttatattattgtccagggaccagcatgcaacaattgcttagaattcaaggaaagtcaactcctttcagcttctgtcatgggcactataggtggctcctgttgcttttgagtaataattctatttcatctatacatgattaaatagaactctcttctataaaatttgtgcctggatgaaccaaagatgcattttcaagcattcaagaatatgcaggaaaaaatcagatccactcatggatacgaacgtgaattataacctatgatgctattatgtaatttgatattttactttacaccattcaattatttattcaataagtaatcagtaagtgccagaactgtgttatgcactgatatcactgagaaaaaatatatagtctctgcccatataaagctcatactctggttgggcaagaaagcattgacaatacaacatggtcaataagatagaatttttagtaggccatgggaatgtggaagaaaagactttaaggcaagctttcgttatcttttgaaatgattgtttcaccatgattcatttacatgcatgcatatcagtgattgaaagtatctatgtatgtatgcagctgtactcgcacactttttaaaataacattcccaagttaaacagagaatccccataaagaatagtaaattagaagtgctttgattggccttggagtatgtagtttaacttcatagatattggactatctttaatatagggatcatgataagccacgctgagaatcgcatttaaaaagtcttggataaattaatgaaagaaatactttaatttttaacccaacagatgtttactttctgggttataaccatctcttaaaaccttagcatgactggaaagctgtaactacccatgaattctgccagtttagtaaagtctttaagataaagctaaaataactgagaaaatagaatatttctgacaatatgttctgaatatataaagctcttggtcaaaaatcatggtcatataaaaatccatgttctgccccttgagtttttaggtcaagtatttatacccatttattaatataaataatacaaattacataaattctagccaagctgtttggttatatttttgttatctttattttaaataaaaaagatcatggacttaagagtaagtctttgcaaccaaattcaatctttgccatctttgacgccggacaaatttttactccaagatttaatttgttatctagaaaataaagaaaatactaccacatagttctactgttagaactgagtccaacatgaggagtggtatagtacctgacacagcataacttcaatatcattgatagttcctcttcatgattgactacaaagcctatgctaggtcatgctttcgtcatttaaaagcattaaacactaaaaaacatcttttcacgacattccaccagaggcattgagtcaaaaagcttaatgatttctattcaacttacttatcttgtggggaaatcaaactcacctgccagcaattgggctggtccatgtgaagagaccactcaaaatattacgtggattgtgtttttccatgaagagttgagactgaccacgcatttttacatattttctcatagttatagtactgagtgatgtctcacattctatttgtaatgcacatgctggagtcagtacattaagcaggaattggggacgttttctcaaattcattaaattataaaagcatctgatgttaaaaattgattaaatatagattcatggatatcacatggatagcttagattagtttgtcagagattggtgtcgatatatcaggcctgagattcactctcccccattcaccaattacaatctaattggtttttcactcactgggttttttgttttgttttgttttaggctcactgactgactgcagctgtaacttcaacttgccaatgtacaccattgctcacaagaggaccagctgagagtgtgaatgaatttattgccagccttttcctactcctaaaacaaagcaattctgtagatttgttactgatgagtcatagcaccatcttcatatacaaataacaacatttcatatggcactattttcaatgtaaatgatagcagagatcatgaggagatagtacaaattatcttgggccattgtcttatttatagattaaagtacaattatgtttttcactgatttaccttctgacatcttagttaattaagttacttgtttcttttatgttcattctccccttagatctggcacgactattcttttctttaatattctttcccttgttaaattgttaattttttctgaggggcagaatacctttttatcattattttgagaatgctaagtatttacataattatccttcagagaacattggaagacaatactgttgaacaaatggataaatattagaaaaggattactggataattctgtcatttctggaagcctcagtgattgatttattctctttttaccttaacatatttttcctctaggttactatttttttcctgacaggttttcaagcttataattggtcattttctctgtttaaaaaaatattctgggagtgcgcaagcgctcagaaaaatattatctattagcaaactcattaatttaagaacctattaataaatttgctcattcatttagaatgaaaaatatctaatacagtatttatatttatatttattttttatatttatatttacatttattttatattttatatttatggcttttagtcaatatataacttcaaaagagaatttcaaatcaaatcttatgccagtccaaaaatcaaataactgatataaacaaaagagtataggcccaacacaaaacagtaagacagagataatttgttagtttagttaggtagtcgattagtcatctatcatacaattactgaaagtctactttgtgccaggaatttcttcagatacaaagatgaataagtcatagtacatcccctccaaaaacacctattctagcaagaaaggtgctacgtaaatgcagaaaagaatatcaacaatacaatgtggtcagatctattatagaggtatgtagagtcactgagagaccatctagcctaatggataatacaatctggcagacaatgtatgctatttctgttttgatttggaatgcattctaattgttgccaagcaattttgttttattaacttttgtgttaaattggctaatatttaaattactttaattcctcatatacatacaattaagaggtagaatgaatgatacactttgatgaatgaaagggtcacataagattaacatttgtaaaaaattaatttgaaaaatagaattcaatcctaaaatggaacagtgactgcaaaactagtgactgcaaacttagaaccatgttcctggaaacttagtagcataagcctggcattgacaatctgattcatggttctcttactatctactcacattgctcctttaggggaaatttgacaatgatgtctggaaaatgtattgctactttcaaagattcttgctaacatttgagcaaagtggaaagcagttctggcattttggataaatgttccccaaatcttccttgccagatatttcattaagtaggaaacctcactagggtaatatgggaaagcaatttaaatagaagtttggttcacaacatgatgctttttgtaaataatattctgggaggtcttctgtgtttttgattaatttaattttaattttactgttgaagttgcgtgcctcgtcctgtcttttgtggccaataatatctccctgccacctgtaactcattttcaaaaagaaactgtaagtaagtatatgaaaacatcccataatttacatgagacttcaataaattactgttatttctaaaaggattacttattcattatgttcccacaaaaatattctctaaaaccccctctctaatttgatggtgcattttaatagcaatattatagcctttcttttaaatactatattattataattgtccctctgtaattctaattcttttgctaaaagtggacccctaagagcaggaattgtgtcttattcattgtgtacatctttgtatctctaactcagcaccaaacaaatacatgtgcttgattaatatttttggagaagtgaatgggatgactgaccaatgtttgatacttgctgacgtctacttattttctagtaaatatatatttcaatctaattgtcttagtttaatatcctcatttgttgaaactggatgaaaaggatcttgagtaattcttctctctatctcacttgcctttgttctggtgcatattttcattctttcttggttggacaacagaaatagccttcttactagctacttgacttaagaatcaccacctcactatgcctgacatcactcccaagtgatctttccagactcaaatctgcttatgtcacactcattctcagaattcttccatgcctgccctgccttccactgtgaatctacattccaatgttattttgcatagacatagtaccatatgtttgacaggtctccccatcttttcatttctgtcccccaagtatcttggatagtgttcattaaataagctgaataaatgctgtttgattgaacgaaggaaggtggctccagtagcccacttgtaccaaagtatgtgcaggagaattagttcatagaaatttccatcggagctctctgaaaatggagatgggtactgtagaaaagcatttctcacagatgatgcctgtgcataaaaattacctgagatgtgtttttaaaataaaagatttttggagtcagaatttccaaagtaagacatgggaatctttattttctaaagcaattgctataatttgttcagggagatttgggagagagctcttagaatagtagttaatatttggaggctagatggctactcagtgtgggaggctgaactatgtgaccctaaattcccttccatgaagttttgggtgctatgattctagtggaggtcatagtatataaatgtgtagaagcaggtgagtgctttgagacgtaactagtgcagataggagggatttgggggtaaatgactgagtccaagtgtcatcagatctagagagttatgaccaattttcaaggattctaataaaaatcttgctctaatccccgagtttaatcttttaacaactatttactgaatgcctactatgtgtcaggtacagttctaggtgttggggatatagcaatggcaaaacacacatactctctgcttttgttcaattggtttgtctagactcaccacacttgtctctaggactctcccgtggttaagagttattttcatagccacttgattcttacgctaactgaaaatgatcatcctcaaagtcccatcgttatccttgttaaaaaataagtgtcagcctgggcaacataggaagacctcatctctaggaaaaataaaaattttagctggatacatgctggcacatgcctgtagccccagctactcagggggctgaggcaggaagatcacttgagcccaggagttcgaggttacagtgagctatgattgtgccactgcacttcagtctgggaaacagagcaagaccctgtctcaaaagaaaagaaaaaagtgtctgagattttcagtctggctggaaactccaaaagtatcctatgtcctctgagggtgtaataggtgagttcagattatcagacactacttcttatcttgtgagatctatatatgtcattggccaaggttcattccagatctagccttgagtctctgacctaaatgtccccatcattttaagtacaatgacatgttatttcttattttcatcttttgaactgggcatttttgtgctcatcttgagaaacccacacatatttcaagctctgaaggtaagatggtcaagtggggataattgtgggctttggaaaccagattaactaaattttggctccacttactaactattgaaccatgaataaattacttaacctacccgagactcaattttatcagctgtaaaattgggataatagtccctatttcacaggttgtgaaattaaatgagatataagacagtgttatatattatagtgcctggtatttaatacttacacattaaaattactgtgtaatttatctgcataaaacagcacactaagagagagagttctgaggtaactaagataacttacaaatatgcacttatggtaatagagaagttttttttaaactttgttaacttttcagaacacctaatatttttatgaaatgtggtgagtgaaaatgatgaccccaagaaaggcaacgttttccactactactttttatacaaaaatccttcatcatagtcaagaattagatttcttgatatttcatttctatataaaactattcccattttaaagaacagattttgtacatacatacaataaaattgccacattttcataagaaaattcattcaaagacaaagtctactaaattaaatccaaggacaggacaagaccatattgaaataagttacatttaaaaatagaactttgcacatgcaaaaactgaaaacaaaataataagcatgtgtgttaggtttttttgttttttattctgttttttcttttcagtaaaaaagttttataagtgtgaatgcattagaaaactgaagaattttcaagagccaagaatgtcatggtgatttctgtgaacttatttctaaggactacaagaaacacactggttgctaaatgtgaattaggaaacatgaactcttgcatacacaacaaccccaaagaaaagcaaaagaaaagactatcttaattttgggtccaaattccacccatacctatagttgcaaaataaaacagagaaaaatggcctttattagcagtggcttaaatgtccatggggtggtgcaattgacttttaaaaatagaaagccaggctatcaaaataaatatcctttttctcttatttattggagtgagggatattttcactaatcactgtgctataaatttaagagacttagagcattttacagtttcttttattcgtcacctttccctgggatccttggaagatgactttatcaaacacaaacatattttttaaactggtagattaaaaagagaagttatttcttttgcttccaggggttttatgagccccacatttatgtatttatcactgtaatttggataattcccaacactaccatcaacaccaccatccaccatgtatattgtacagtaggatttcttaaatatttccatattatggcactcattgaaaatagtatttgtgtacacgctggggtaaaagagaagggtttgtccagcagacattggaagcaaaaggctgggccccacgcctaagctctgagagctgcaggaatcactattgttggcaaacctgcagcctgtttggaaacactggggtatattagcatgccaattggaaagctctgtgtttgatttcaaataatgcatattagtagtaaagagagaataatacccttcatcccatcccaaaaagaaggctgacaataccaagtgttagagacaatgtggataaatcattctactacacattgttagaggtaaattgacacaagtgttttcaaaaataattcaatattatcttgtaaagctgaattttcatgcattctacaatccagaaattcctcctcaagatatgtgcatatgtgtgtgtatgtgtatacatgtgtatgtataagaagacatgcaccagaagatatgtacaataatatttttagcagtactacttgtaatagcaaaataatgccaactctaattctcattgacaggaaaatggacaagtaaattgtgatatatttgcacacacacgcacacacacaacgctatatatatatatttttgaagtttccttgagcctaaagtttagcagaaagtatttccgtattttgtattgcatcttagctttctattgaaatagattgttttcaatgtctatgttgatctcaggcaagtatttgagccttaagtctcaagtaaaggcaattagcaaatgtgaacctgtttgtactgaattgggtttttccttttctgaaattgtcaatgaaaaatttggggttccaagtagcaaattaaattcctgagcaattttacctgcgtaaggtaattattcatggtttgagagaaaggaataagattgtatacctatgtaactgatatattttgtcttaagcatgttttcttttagagtttaaaatataatgcttaatgtttctcatctaacttgggtataataatgacaatcactaaaacagaatgcagcttgtcaagcaatttaactttagaaaggaatgtctttaaagaaattagaaaagcaggaaggagaggaagagattgatttattagtctcccttagtgtgttcaaaatttaacaattcttcctgtctagaaattgttatatgtagctttaatctcttctactacaatgcaacttcattttctctttttatgtcttggagggcagagggccccaagagtgtaagagaagttaaagaataaccagctctacaaccacaattgggtagtgttgacacgactataaaatgaaagctattccacttgttctatcacccttaaactttggaaatagtgtccaatagtggaaaattaaaaaaagaaaaaaataaagcttgccttgttttccacaggaaaaggatcatgagtctgtctctccatgatagattagatcaattgcatttctttcaaaatcttttaaaaacaaaagtgaagtctaaaagttttatgtcatcattgtgatatcagtaacgtgtgacacttaagcaattgattcctatgttcattttgctttattaataatcctttgtatattttctgacacattatcctgttcatactttcataatcacttcaattttgaagatagtctcatcgcaacatgtactcatgagggccagtttcatctgttggagattgagatcatgtatcaggaataccctttgagttttcgtgaccttaaaagcaatgtgaaattggatcacaattacagaaaaatacccagtctgtaactatttgtctcagacttcttaatggtagctcttgtacttgaaatgagttagagaagactgttcaacattaaatcttttctgtggaacttattgaagtacatttgaagtttattattctcttaaaagtcctaggaagttttagagaaaatgctggttccaagtatgtactgtctctcacatgacatttctaatgatcctcaataattgtacagggaatattttaaatatatcaatgtattcactatttatgaggcttttattgcaaacaatgaattgatttaaacatagtaaaatgtctagaaattattaaaaacaggaaatatacactattattattccaagttttggggaaaataaataaggcacattggtgttatgtcacttattaaccggcaattattattcttctcagatttttatgttttagttgttgttgttgttgtttaattttagagacagggtctggctctgtcacctaggctggagtacaaagatacgatcatagctcactgcagccttgaactcctagcctcaagcaatcctcccacctcagcctcccagacagttggaaatacaggtgtaaaccaccaggccccacagatctgtccaaattaatcattaaataaatcctgagtagtagaagatttgggagaaaagcctttctgcttttgtgtgatccctgaaagtctgtctagagaataaatttccagatgccacacatgcacaaaaaaatttacctataaataaatttataagtttttaaataacatttgcaaataatgtttattaccaagccattttataattttgagttgaaataaattacattgtttacattgtttgtgatctatgattctttttgcaacaatctcttaccaagtagtaattacatacattttctgaattacagtctaaattttttttcaattagaccttgctaattttttctagattcttgatttcaaatatcagctaattacaacactacattttccatgaactttgtaggtccaacgttttgtctgtaacttgataaccaatttgaattaatttattttggcatcttatggaattagtgtaaatgatctttcattaaggtgatatcagtttaaatcacaaaatttaatttcaggaatgtagctccattcatctatttaattcacttatgctaatacctcaacatatggaataataagcaaactattgttcattaaaaagtagaaaagtcaaaataattttctgatctaatggttagtaatattgctataagcttttactagtttctacacagaaagtgacataaagcaaagtcatatcaagataaggccttttctttttaaactattgcctgaaattctttccaaataattcagcaattagtcagaaaactactagtttgatggaatgtcatgttgcaaagataattatcactattacatctaaaaattatttctacagtatgaatagattatgtctctagttgtctactgaggaatcttcatctataaatttatgagtatattttaatataatgtctatattttaaaggtatggacagaaaggaattctgtcctggtctatgcacatgggaagctcttttttctatccccagagggttcatgggttttggaggtcaagtccaaagcatgtgctctgtaaaattcccagacttgccctgagctccctctggaagtctagttatacatttataagtgagaaattatagccaggccaggtcacctgcaagaccccaccatctactatgagtccctatctttaatgcagctctgatttcctccttagaatatgggtgttgcacatttaaacaacacatgattccatttcccagctatcaagttagcaatattttactgaaattggaacacatagttgatataaatacaatagaatcaacactttaaaatatgaatagtggcaattaattgataaactctctaaaaatcatcttggcaagatgcactgaaaagcttaaaatgtttgtatcatctgagacaatacattttatttctgggaatatatcataaaaaactagagtactgactaaaagtgtattgaaaggtgtttatgacagtgacatttgcaatattaaaatataggaataacttaaatatccaacaaaatggaactgggtaaataaattttagtatacctgtacgaggaaaagatattacaaataattaaaatttataagattattcataacatgggaaatgcttttaaatcaatgaaaactgaccattgaaaaaaaatctttaaaaaagaatcacataactttaggaagaattgtatctctgtatgtgtgcatatctgtatttgtagctatttctatttttctatctaactatatttaaaacgcatgacagctatcaaggagagactatgaccagtttgttcttctaaatttctttacacttctaaaatttttcaaaattgcataaaattagattacattatatttacaattacaagaatcttattaaaaaatagactcagcccttggtagtggaaaaaggagtgtccttcattaagaaatgtatccctgtctgaaatgcaccaaaaaacactatcaaactgcttccatatactagaacattccatctcttactcctgggtgacaaattttgatacatttgataacttgattcatataagtattatcaataattgaggcacttagattcatgtataacaaaatttccaatacttcatttttgtcaagtgtaaaatgatatgggtaagctgagagtttaaaaaaacctcaaagaaggtatgaaaattataattaagaaataattataaaatcatgcagaattagacctttataattcatcaagtatagtataaacaatttttttctgtgaattttttttcaatgtacattttacatgccttcttacaaacattattgactttggaggacttgaatatgtaatgtttggaaactaaacaggagtttattagtttcacttagagtctttcaaacgaagtcttggagttgttaaaagatctttgctttcatcctagaaattattgtgttttttttatattgacaccaagctggtaactttgaaaatggaggaatgtcttaggataagcacaacttggaagcaggcctaactgctcaattttatccaaataactaaagttagtggaaggtaaatggtttctatggggtgattatgttcatggtaaacaccacttctaagatatttatttcaatgctttataattgagtaaatataggtatggaaaacgtttatcaattaattgtattgacttaatatgtatgaagtttgctcaacaccagacacatggtagtacagtgttctgcacataataggatcaagttgaaaagaatgtggaaggaatgagtaaatgaaaggcctttaatgaacccgtttccttccttttcatctctgttgattccttaattgatagctaaatcaaaaattcaaatctgcactgtgacatggaagatttcatgtttataataatacaaaacaaacaaacgaaatatatttattttggttaacataatttaaaaactttcagagtaaaacaaattcagttagtaggcacaatgctggtttgttaaattcaagtttcaggggaaatggaaattcttacatgtgcctagataataaccctataatatatattttcatgattacaataaaattacttataggcccctacagttacactactgagagctgcaatcacaatgaatttgcacaaagaatgcaaatttcatttttgccagagtgatatgacttacatcacatgtggctgttatagttttaatagatgcttagcaactgaatctatagcttttgtttggtaatgtctattttaggaaaagaagcatattcaaccggaactaggaaaaaagcttgtttttatattgattgatgcacattaattgtttaagaagatatttaaacattccccaagaccttcttttgaataaatcatttgctaaatcatagggatataaagcataatagaagggactgaaattcaacaaatgcttataatttgagttctatgtgcattttagatatgtgtttgtgtgggtaacagaaactgaataatatatttatcttgggatagaactgtcatcagtaagctaagaaactagaaattgatatctctgcttgggttaatttgaagatgatgttgtgtttgtttgcaaataatttttaaagtaatgaactacccactacactacctataggctttattgaaaactaaaaatgcaaaacaattgagataatgatcattttcttaagagggaaatgagaaatggttttacttttcgtcaggatgccattgcagattaaagaaaaatgtgatttcattgtatgctacaaaggaggatgacatcaaagtgtcctcttggtagcaagctagctatataaaccacaaaaagagagctgcattaaaaatacaatacattgaaacagtaatttttcaatgctatgtaaatactgtggacattttaaattcaaagataagcagaatcagcagatagtgatagttttaaatttgctaaaaatcaatagaagagcagtaaaatgcaattttcctaaaccgggctgtaacttcaagtgagctgaaccattctgatgcaactgagagatttttttttttaaataggacttaagaaaattgatttaacattgtttcattttattagtggttgagcaatataaatgtgaaatgctttgaagtaatctgcattatatttttattagcttcagagcttctatatacgtattttatattcttttcaaaagcttaaatagtattacattctaattattatttgcagatggtatttgtttttcttgtaatgaccagtcagaaatcatttgtctgaattgcacgaaaaagaataatttcctgttgagtagcagttactcagtatgcattctagctcttgctatctcagagggaaagatttaaataatgtatggtgggttcctttgtaatgaggtgctcttttcttacgttttgttgtgattttgtcacgttagaggaaatgtcattaaagggacacaaatcatatcaaggattttatcaatgctatataattgacctatatatcttttaatgggtgggtgaatgtcattcaaggctcttgagcatttaattcaaatactaaatttaagaaccacaagcatattgatgagttaggaaaagacagaattgtgtggataaagcaagacctgggtgaacaatctttctttctttctttctcattaaagattgatctaaagatttttttgaggtagacttatttgatagccatagtcactttttggttctcagagtggtaataaagaaatcgctcaataaaacacaatttcccttttctctgtgtctggtattccgtttctcttcaaatgcagctgttttcttcatgcttctttcaaatatgaagaccatgagaaaaacaaaacaaaacgaaacagtttcagaagagcccggtagctttttaagccttgaactgaaatcttgcttttaagcattatttctaaaataggcaatcctgcaataataaaaatgaaaataaaaagtctaatcaaaatttaacaaaagagtaggctccctaaaggtatccttcactgtctgtcacctcttttcttaaatgtttcctaaatgtgaaatctcttgtatcatctagcacacttgatttcttcagttatcgatatttattttgtgcatttctttttattgcctacacattttgctattatgtcatgtcaggcactttgtcaattgacagtatacgtagccttgtatttggatacatatctaggaggcataataagtagtagcaacccatagaacacaaatcagaacttcctatgccagaaaaaaatgatttaccaaagttctatgatattctcttaaggtaaaacattagcatgttaattttacctgttttccaaagagcatgccattattattgacatgctactggctttatggtcccaggatgcatgaattattagtgttgcctgacatttttaaattcctaactctatagcctatagcagtacttcctgttagctattatgagctttaagagtgcatgctagatgctgatcagtgattgttcagtaattcagaggtgtcaaattctctcgtgggttaaaaaaaatgttggttctttctggatttttataagacaatatataaataaaattttaacacactgaatctgatatctagaggagagccatcctgatttttgaaaagaaactgcactttcctaccattatttttctaagaaataaaaccatactattcaaatgcatttatttatttgattgtagtgccttttttctcaaaacattacaatgaaatattataacagcactatatcacacaaaattgaatttatctcatttttttaatccaaaaagtccacctaaataggaaaaataatgaggatatttaatttatagaaagttatggtatatttacaagtttttaatgtttcaagaacaatattcggatcttttattagactgagtttttaaatggttgtttgttatagaaaaatacaaacatttgaagcaataaaatattgaaatagaaatatcaaagacatatacttttatctgaaacaatttttatctttttttatattaacattttcagtgtgagaagatgttaatctttaagtgaatcaatgcattctcaaatgcatctgtgtttggaatttttaattggtaaagaatcacaatggaaatatcttattttcattttttccctttaatatctattaagcctgccctatcagcaggaagcacttgcaattaggaaacctgtaatgaaactcagcacaattaattccctgttagtctctcatgctagatttctacttctggatatgttgctaagttttgggtttaggcacttgccttatatagactgacacccagctcgtcaaaggacgtattacaaaatcccagtgattagttccagtgattagttgagaatcacattttctagcactctcctatcgacaaacccaatggctgattttaagctcttgtctcaacttatctctctaaagcatttcaatctataggaccatttcctatatcttgaaatactcttctcctttggcttccattcttcttgttctcatctcatcccatctgttcaacaatccttttgaacttcctttctgggtcccttcccatttcccattttttaggttctattcttggtactattctcatttatccacctgtagaacatttatgaagtatttactatatagaaaattggctgtgcatggtggctcacgcctgtaatcccagcacttttggaggccaaggcaggtggatcacgaggtcagtatttcaagaccagcctgaccaacatggtgaaaccctttctctactgaaaatagaaaaaacagctgggcgtggtggtgcatgcctgtaatcccagctactcaggaggctgaggcaggagaatcgcttgaacccgggaggcggaggttgtggtgagccaagattacaccactgaactccagcctgggcaacagagtgagactctgtctcaaaaaataaaaaagaaaaaagaaagaaagaaagttgtataaaaaactctgagagattcaaaactgtatacaataaggataatatcctgaggactttgacatttaatgtgtaaatcattccaactggatatcaatgcttgtcttctctgtacttcaattctacctggataatctcactattctcaagacttcaaccacagtaaatagtgaccatccctaacacttctatctagagctgtgctttcagctccttactggacatctccgcctgcttgtcttctaggcagttataattcattgtgttacacattaaattttccctctaccagcgctctttcacatcccccaaaatcctggttcatctactgaattctcagtcttcaacgctgccacatgttttaacacttctccaacctcatactgtctaatttatccttgagtagtgccttctatttcctcttttatattgaattcattaccccagtttgctgatttttctcaaaaaattgtttctgaatatcaatcctcatcaccatcttttatctcggtcctatatcacctctcatctggataaatggcaaaagtttcatattctattttcctaccacatttagtagtggaagtataaggggctttggaatctttcaaaaatgattaaatgtacatgacttggtcatgtgattttggatggctgattgttctaagcttcagttttctcacctattaaatgaagtaatctgtgcatttcaaattcgttgaaaaaattaggtagtatcttgctagaaagtgattagcacaattcctggcacatattaaacacacacacacacacacacacacatttgttacttgttcactgcaatttatcctggacaacactgtaaaaattgtcttcctctaaaaacttatttttctatttaaaaccttcaatgatttcacattgcctacaactcacaattcacctggatattctaacaccaatttacttctctgacttcactttctacccctccactccacgcacgatttgattcagttgcaccaaccttctcatcactcagagctctctaatccctgtgaacactctacaccttacgcatactgttcctactcacttcctggaaaggtcttctcccacttctcttggtaaaactcctactcatctccaagaaccagctcaaatggcacatcttttggaagacttccctgaatcatccaagaaggaatagttatccttccacttgtgtttctggatcactttctttgcaaacataatagtatactactttcttgtgactttccctatatgagtttcagtttgctgaacaacaatagtaataattagcatttatagagtgcttactgtatgtatgatcttaaagaataaatttatcttgctcatctcatttggtcttcactacaacacagtgaagtagatgctattttattcttattttaaagataagcaaaatgaaacttaaaagtttgcaatcaatacaaaagtacatctattaaatatcaacaaaaaatttaaagtttgtaattagtctgggatgaataacttacatagatctgacttcacagttcacatataatcacatataataataaacatatataatcatagattccaatatcttatgtttgtgcacaaacccctttgagaatataataaaagtaaaagaaaatgcaattttcagatcatgcagaatttagtatacatcaggtagttcatggatcctctaaaacagttttatagacacttagaatgccattgatctaaagataggacactcttctttacagataaaatttttgattatgtaatctgatgaaaaagtattctcaagcttttttatttgaaaataacatttatggttaataactaattgcatattttcaaaaagctaaaagagaattctgaatgttcataacagaaagaaatggtacacatttgaggtgatggatggactaattaccctgatttgatcattatacattgcatacgtatatcaaaatatcactctgtattccataaatgtgtacaattattacatgtcaactaaaaaaatccacatttcaaataccaaccttcagttatccccataaagtggcccataaggaacttctaactttttacattctatggaacaaagcttgaaaaccactgggctaaggtagtgacatgttcaatccctcagaaatgtttaattctctccaggttggacagcatcatgaactgtgcctgacttaccactgtattccataatctgctttttaaaggatgatttacacaatcaagctgttatctgaatatttaaatgaggatgggatttaaaagtggagtaagatatatctccacaactgaggtagatagggcaaattacttttcgtcatgaaaactgagtagccttggcaaatagctgacacgaatgaagatatgctgatctagattattaagaccaccactggacatatttggatcagtgctcaagcatgtgaattatgagttaatcagtaaataaaatgaacaaagttgtgattatatgtgggtagcagaggttgcaaattgcctgccagcagactcaatttggcctacaaatatgttgtttggccagcataatattttttaaaaatttaagccagtatttaaacatcaggatatttggtttttttacatgaatccctgagtttccagctttctcttgaaaatttggaagctctgacaatactgggcccacattctcacatggtgacaattggctagaactgaaagcagctgtttcctctacacaagacatgtactttctagtacagcacaactcccagtagacccacttcacacatatacctgtacctgcttgtcccccattaggcagttgtaaccctagaagactggcctaaaaatttgaagagtttataggaaactgctattttaaataatgcatcatgtgctgcaatgcccccccaccaaaaaaaaaaaaaaaagaaaacaaaaaaacataaacaaacaaacaaacacctcttctagagtgtaggctggaaacatatacttctaggtagccactgaggctgttatgacccccaagaaatgtgaaaacagaaaattttcacctctatttatttggattcatacccgttttactacggagaaacaaaaggcttgcattttagcctatcagtcaaaggcaaatcagttctgcaggtagtagtgaaacagcatggaagtcaggtactctatgatgtgtgtgaaatcaaatccagaagcacagtatacttttggtgaattaagttacaattagatgtaacttttagtattacactataagaaagaggatgaggttgaggtggggttcaaacttcttcctattctcttcatattggtattctttcatttgtgttatcactgttgaataagaaaatataatataagcaagcaaagcaaatgggaaaagattttataattccatgttttctggtttctatctggtgatgatgaacatggtatcattaaaatggtctagtagctatagtatttccagttattctaatccttataattctacaaggctttgaaggaattctcttgagaaaaaaataactatatcacagtttaattgtttatagtgactaatcaacataacactaaatttctattcatggtgctttcttgaatcttagactagactatgtattggagaactgatttgatttaggaggaatctgagtccttaaattattatggaaaaaccagctcacatttctttgatgtgtcactcatctttcagtagccctgctaatattagagcacttcatttttttccaaagcactttcacatactggaaagttgccttcaggtatttcaattaagtcaattttaggatatttagcctaatggaagtatgaacaagggtagctcaaatagaagggcgactgattcaggacttttctttctggttcagcagtacttaaggactgctgagagatttaataactctggtaagtagtgacaggagaaatactatctaggaagactccagaaatatgagagttgtcatttatattagatctttgccgtttatggatttaccatttgaaatctgactagtcacgagctttccgaaaagtttatgatattttaaagctatggtcattttttcaaaactccaaatttgaattattttcttttaactctggtaatgtgaagaagtcacttagctagtaagtattgtgagtcactgagcatcatgctcaatgctgcttgtccttctccaaccatctctgcccatacaaaacatttctcttagaactgtttaaaggaaacaacaaaactcagttcctttgtggaaagaaaatatcctcaaaagagagaggcaaaagcgattaaatttcagtgaaaggatttctcaactcaaacaagccaatgctgcgctagcatttctatgtttgtaaacttggaaattgaaaatctcaaaaactgaaaattttaggagtctactatcctttataggtaccctttaatacttgttctcttatatttcaacaatggaaatcgttgagcttgctaaaaggcaaatttaatcttcacttagtcaaacaaaaaatattcattgagtgcttatttatgcatgtcatgggattacagagattaaaacaaagcattattacaaataagtttccttccagagatactccgctccctcttgatttaaagatctctgtatctgatcatatatgtgattgtctgactagattcttttcaccccacgctttttatggtgactattatttttttaaaaaaacaaggctggccccagtggagcatccctctaatcccagtactttggggaggccaaggcaggaggatcacttgagcttaggagtttgagaccagcctaggcaacatggtgaaactttgtctctacaaaaaatacaaaaattagctgggcatggtggtgcatgcctgtagttccaactacttggggggaagagacggaaggatagcttgggccagggaggttgaggctgcagtgagccatgaccacaccactgcactccagcctgggtgacaaagggagaccctgtctcaaaaataaaatcaaacaagcaaaacaacaacaacaacaacaacaagtgtttgcaaaagtgtggagaaactagaactcttgtatactgttggtaggaatgcaaaatggtgcagctgccatggaaaacagtatgaaggtgttcctcaaagaaattaaaaatagaactaatatatgatccagcaattccacttctggaaatttatcaaaaacagttgaaatcaggttcttgaagaggtatgagcacttccatgttcattgcagatttattcaaaaacccaagatatggaaacaactcaagtgtccatcaatagatgaatggatagagaatatggggtatatatatgttcaaggggaatattagccttaaaaaagaaggaaatcatgaaatatgtgacaacatggatgaacttcaaggatataaagtgaataacaatatcaagtgaataaagttgctaatcaatgggctaaagtttcagttatgcaagatgaatccattctggagacctattgcacaacattgtgcctatagctaacaatactgtattatacactgaaaaatttgtaagagttatatcttacattgtgtttgtaccataacaaaatgaaagataatagatgtatatgtgtgtatttatgtatgtatacaatgtggattattttttaaaaatacccaaaagctattttcttctgcttttgaaaaaaagtttcattattagaaataattggtcatttattttaaattaacactatagcaaaagggggaaaagtttttttaatactagaaatctgaaagatttattgaacttgaattactctgaccaagtatgtaattgtaacaatttgggaaatgtttcaaaatttgaatataaattttacagtttttcacactatatctacataaaaccagcagatgttggctgtgtgtgtttgtgtttatatactttacaaataaatacttagcatttatatagcaccttacagagcagtcaagcatcataaagtcattcattttatcattaaaggaaatagatgtcaagaataacttagagtatattttttatgtcatcaaaagtctaattctataaaagcttgcaatagagaagtgggagggaaaaggctgctcagagaagcagtctttaggttttcataagttagggaagtgtgactgttacttacagttaacatagaacatataagaattttctcccctatgtgatcttggagaatattgtttccatgaataatagaagcttagaaaaagaaagagaaaagtccctaaacacacccattatctgactttacatgctaagaacaaatttgactgtcggtttatgaggcaagagtcagatctaagacctctgccccaactgtactcaggatgtcaattgtcaacatacacatagtcacaagtcgagaagtggagtaccacagaccttagcatctgcatgcaaagtagctagatatgacacaaaagtggtttctttcttggtttttcagctggtaaaggtagattttataaattaaaaagcacatcccttcatggttgtagtagactttttttagttcatcagtgtaataatatctccctatcataaaatattaattttattcaatccaattcatatgtgcttttctcattcatagctggaattcagctctccaggtggaaagagttaatatttgaataagtgattccacccatttaaacatgaagaagttgtcttaatctctacattttcatggttgccaatattttgattaatttccatgacttctattgactctgatgcttgaataggttctccagatctgtaatataagttattcatatagacctagaaattatcagtatatctcctgtgaagaaatacttcatgtgaatgttaaaataccttaggaatgtggctggtcgtggtggctcatgcctgtaatccaagcactttgggaggccaagacaggcagatcacctgaggtcaggagtttgagaccatcctggccaacatggtgaaaccccatctttcctaaaaatacaaaaaattggctgggcgtggtagtgggcacctgtggtcccagctactcgggaggctgaggcaggagaattgcttgaacccaggagagggaggttgcagtgagccaagatcacaccactgctctccaacctgggcgacagagtgagactctgtctcaaaaaaataaaaaataaaaaaataaaaaagcaaacaaaaaacaaacaaaacaaaacaaaaaataaacaaaaataaaacaccataggaatttattgatcagtttatgagttaaaataacactaaagttaactttcttgaaagaacaatatgatttacatatgccaggaactctagacacattaatttttttaccaaactcttaggagaaatcagttgtataaaatttcatacagaagtaactaaatcttaatgttagttaccaaaaagcagacatgactccttttaaatgtgctttcttcattttgaaaaataattagcactagaatgttttaggtggattattccaaaggaagcagtatagcatggtgatgaagttcaaaaagtgctcttcagtcagattgctttttgcaaagccatgctctgacaattctaatgttttctcttgggactgttttctatatatcaaatggaaaaaaataataatgccaatctcacagagtggattgagaattaaacactccatttaagctgagcattgtgcctggcacatggaaaatgctccatacatttttgacattagaataataacaccattaaaatcgaggtagtcgtagtataaaaataaattagactttatcactttggggtttcaaatttttacttacaattggtttggggtgtttgctttaagaaatgttgacagtatgtgtgtgggagagcatatttctgacttctttctttcctgtaaagttaaatgtgggatttcagttgtttgcatagcattcgaacaatcatttatacatgtttctaagatactatctctgaaaattacctctagaagcttcctatctgtttcctgtagcttgtagtctacaccaatgtagatgagataagtgtagtattgcatgctaacatattctgcaaaagacagcatgggtttacaaagtttcattgactcaattattattggagttatctctacatatcatttatagtaagcattccaagcagcttcgtcataaaattcttagtaggaagaagtaactaacatagataaggaaaaatcaaatgctcctatatctttttttttttttagacagagtcttgctctgtcacccaggctggagcatagtggcatgatctcaggtcactgcaacctccacctcccgagttcaagcgattctcctgcctcagcctcccaagtagctgggaccacaggtgtccgtcaccacacctggctaatttttttgtatttttagtagagacgggagtttcagcatgttggccaggctggtctcaaactcatgacttcaggtgatccgtctgccttggcctcccaaagtgctgggattacaggcttgagccattgcacccggcctgtatcttgtctttacgcatacatttatttcatatctacttcagaggtctgctgtcttagctgaggtttctaatatttgcatggggtgcacaattagtaaagttggtactgatatatgtttcagaggttaaaatcatgcaagaatatatctttatagagtcccctgttttgctggagcctgcccaagactttttgtaataagtagcaaataaataatttgctatattttacagagaccccattctgcaaaaaaacccatgaaaaacaaaacaaaacaaaatcttgcctatagcatctatgagattaggatgtttcttagtgatagaaataagtgagtgttacataatactataatccaaataattctaaatagtggacttttcaacaaattttgtgttttaggttgctttattccattgaaaaatttaaaagtaaccatgatctcaaatattctaatgttgtgagatttacattacaatttagagtgtttgcatttttattaactttgacttaagaaaaataaattcagttgaaattaactcaatatgtttcaaatattttctaaattacttttattttactatttcatgaattatacttttttaagttttaggacattgttgtgattataatattctaaagtaaattattttagaaaacagagaacttaacaaaatttaagtcagctacctcctgtcagttaacacagtagctcttagtaccctaagatatcccctcttttgttctcttaagaaataggtgtccctcaaatatctgcatttatctctgtccatatggttttgaacaagtggtgaaagtattcactatttgctgtgtacccacacttgtatagttcagctggaataccatctggtgtggtactcttcccattttcctcattttgattgctttctcaatctggaaaatggtagcttgatcgtccaacgggtctccagatggctgctggatcattctatgtagtatccatcaacaacatttgatgggttatttaaagttcatccaaggtatttgcaagttcattattcggtcataaaatatcagaaatttcaattggggaaataacataatctcagatttcaggaatgaaatcttttggattagtttgaggaaagaaataagaaaacacatttatatctttctaagaagcagatggctactcttacagtgttagttatccaaaattgtttctatttttacccttctatattggctaagatgacattttagcggaaacagcatccttgcatacagaccatctttgttccttgaaggacaactgttgaaattaaaaagcatatgagattaaatttctgcagaaaaatgaggcagaccaacatggctataaggatcaattagtgtaaattgaataagatcataatgacaccacaagatagatgtgatctgaggcaacagtgtatagatgtaagacaatggtgatgtatatccttatgtgaatatataaagcatgcttaaaggaaatcatggtttatcaccctcttttttttgcctccctaccaaagcatgccaaactttaatgaattttggagcaccaaaaatttatagtttcttaatgtatcatttaacagcctccatttctccatgttttggtaaataggatgaaagaaaatcgtttttcccctctactcagctcctgttttatgtgtagctgattttaattttatcttggttacatttcctcattttctcttctcattgattcatttatcctttcatttcacagttaccgagtctctaccagagatttagaagagaccctttacagtgttagttatccaaaattgtgtatgcacggaattctgcatgaagaagacataggtctgggaatcaataattacatttgatgtcataggtaccataaggtcttcataaggaaatatgaaactatggaaagacccctagtcttccaggtgggttccatgtcgatgacaccttcatattttcctcaggtactatctgcatataaaaatttgcttcatttgatctttcacacaagaattactaaggtatattcaatgacatcatttgttgtgtaagtagaaatacgtctagctggctcaaaaccttaacagtaaaccttaactgaaactgaaacataattttcaacttagttcatttgtgtaatacctgtataaagtgtatctgaatgaattgttcccttcttctaaatactatgtaaaaatggaagagacattcatgactgtaatctggtgtctattcattctttgggcaaagctttattttacgacctctagcatgtgaccagaatttagctttgtctttcaagctttagcctttaagttaaactattattgcatgtcttattttagaagcttactgagaaattctttttatctccaacttttacaaaatccttgctctagaatttatcttcttcaaagtggatttggattgtgttacatctatctcagaagagatggtttggcttcctgttaagctttaaatttatttcagaactgattgaaaatgatatttaactgatacttgtgctgtagagtagtatttgagtgagaattagaggccaggcatgatacctcatgcctggaatcccagcgctgttggaggccaagtcaggaggattacttattctcaagagttggaggctgcagtgaactatgatcacaccactgcactccagcctggaggacagagtgagaccttgtctcaataaataaatgagaattatacctgtaggaatcattctgaagattgagtggtaccccctccaagtactaagctaaagattaatagaatataccagttttagtttacatctggtagcattatcatttaatcaggaaatgcaaagttattaaactaattcaatttttatttaattcttgtcactcagtaccagtcaattaagaatatttgaatcaaataaaatttcagaatggccaaaaaaagacacatccttacattatgtacataaaatcacacaaaatttcttttattttttatttgttatggagttatgtaagtatatgatgccattatcatgaatttttgtgtcaattgatcaaagtatactttcataaaaaaatctaaaatggctttagaaaacattctttaatttatttttgcaatgtaaatatttcaagacaaaataatgcactctctaactagcacctatgtataacccaatgataggatacttcattaaatcagtctttgagctgatccatgtacttttttttctaaaatgatgagttcacataaaaataaggtatttttgacaaataacttctattttttctgacttcctcaaatatagcatatattttggaaatccaacgcatttattgagaataagaagaaataaataagaaacagttactatgctaaggacaaaaaatcatcagaataagattcacactgtataaaaacaccttgatctttcccacatgctattacaaacacagaaagttcagagatcattgctataagagattgaagtttcttaaaaacattatatccagtgaagaataatattttaagtattaagtattttcccctctgaaagctatttttaaagagtaatttctttatttttccaaattactacagcttttcaaaaatgcctgatatctctttggcaaatctttgcacaaagagtttgaattttcctgagaatcatgctcattaatgaaactgaaggacaaagcagagaatgtattcataaaatattttgatatgtttcaatgtctctgtacttgaaattaccatggcttagaacactcttcatcacgcattagttttatttttatcttttagtatctcagaaagatcctcattctaccttatctaaattggcctccctaatttatctctatctccttgggtgttaacttcctctatgaaagttttctctatttgtaatcactgattctctttattgatttgtttttgcatctctctcatcatactgtaagcttcatttaggtatcaactttgtctttttttttttttagcaacgccattcagtgccttgcatagtgcccggcaaatagtagagctcaataaataaatgttcaataaataaatgagtgaaataaaacttaaccatactttttattgcttacttgctcacaatgggcaagtgacatattcgtatatgtgtggaaaaaatcctattttccaagtgggagcaattatttattattatttcagatacaacaattgtgaaatttagtcaatatttacacaatagcagtatgagagcacagagtagtaactttggaaagaagtgataattctttccactttgccatcatttacatttttgtcaactttagaaaaggagaaaatggtgagaaaaatctgtaaaaagtttacacacaaaagaatatttcaatgaaggaaaatatgtcagcttactataccatattttgttctttcaaaatattacaaaattgacatgggacataatggtgtttgatgttctaagaaaaatacaatatgtttaggagactgtatatgtgatgtggatgcatcactatgagaactatataaggaactgctaacattgcaaaagcacagattttcagaatggtacgtatatgtgcttaaaattgctggtgtgctatacttaatttttattctattttaaagggtcattcatttatcttttatagacaattttcacagcttatcatgaatccctagagctgctatgattaagtcaatacatttacataaatagtatgtaaatgtacttaagtatagtgttcttgatatagcctaaggtgttttatgtgaatatatccaacattttgctttttgaaggagaaaaatgtatttttatgcttcatcacacatacagtaaatatcctttatgcttgtagattcccaccttgcttcacatcatccatttaattttttatatatgcagcataataaattcatgttgctaaattcaaactttgtaagagtctgacccattgtaagtgaatttcatatctttctctgtgcttcactgatctggtcagaatatggacttccttttatattaatgaggattttgttctgtgtttgaagccatgaaatcggatgagaatgtgggaaataccagaaaaatactgttcagtgatactgttactatgaatgctttaaaaaagattttctttctcaaaaaaataataaactgctttgagctttttaaaagtcacagaaagttaaagctagttctatgaactaattctgtagaggagggaaatgaggtactaagtgttgaacctatagtcacatttcagctagtggtaaaagcaggaatagaactcaagtctactacttcgcaaactgatgtttttctcagactcatctctgggaactcagtttttaaacaaaatttagaaaataataataataatacctcacataagattgttttcaggaggaaatgaaacgagataatagatactatataccatgcctgccccatggtaggcattcaataaactatagctgctgttattacgatcatctgcaattggcattatttttatagttaatcattactactacaagcatgaataatcttacagcacttcagtatgagacaatctcaggatgggtagagctcgcctatgattggaagaattcagcactgttttggcagaccctggctgcacccagtttaaaagtaattagtcctactcaaccagagtaatctggaaattggctctcaaaccatatttgcaattttatgtgaaaagacatgattcaatatacagtaatggttaggtactttcagtgttcaacccttaggtccttgtgtaaagaggattgttgtcaaaatggaacgaagttttgcgtgcaaaataatggcaggagaagccccttaatcagatttacacagaaaaggaggggattgtgacatcatgtgaatgccaacaagtagatgcactgaatgtgaaaatcagttatttttaatgttagtgtacatattagcattaataactggacatagagttgtccttccagcctctgtgtttcataaagggaaaaagaattcaatgtttgtcatgttacatttgaacaatatatttacttcaaataaagacattaaaataccttgtaaattaagtgagttccataagatatccagtggtcaagtaaataatgggaaagttagtgataaactataggtgaggaagaaatattttcatgataataatcacttttgtagtaacaatcatgatggtagtgacaaatgcttgataggtcaaaccacatgtgtactcaactgatccatgacttcagagttactactatcagcaggacttttactggaaaaagaaaactgtaatatctctaagctcagtttgtcatctttaaaataagttggattttaccaaatgaccacttaagtctcttccaccactaaactctcaaaacaattatattgctgattcaaagatacccgtttaaagatagagccttcatacatatggacccagaatctatcaggactgaggattgaggggagatgttccaccctgtgaggttctattataataggtcaaattgacacccaggagtattggaggatttggcagtgagcccagagatactgtttccataatcacaacctattttgttcctgaccccccaggacagcatagacctagttttgacttcaacaggaaatcccaaattcagagcctgaagcagaactgcactgttttgcagaaatgggaaatcagttgcagtgtgctgacctattcccttagtggaggtgatataagtggcatcacaaaatcagcttccttttttaatgctcacatatcttgacacttatagcttattacatcacatattatcctccatccagatattatctggaaggtggtcgaaggtattccgtagtctttcagcctcaggattccaggttttcaaaattttaaagagaaatccattccaaatttcctttgtttaaactattccagaaactgaagtgcctctaagtataaatgacaggataatagaactttaagtcttccttgcagtgactattatgctttcattttgcacagtagagctcaaaatgcctcactttatgctgatggtgagcacttttagagtttttcatcttcctacagttaaaacatatgacaaagtggccatttgaaaaagaaatgaaggggaaaagtgagcatgaaattcacagaaattgagaccataataaatactaagtaagtacacttccatctacatctacttgtagataaaatttcaaatatgctacaccaagagatttgcattgacagattactttttgtttaaaactagatactctgggaaaaaaccaatattcatagtaaagacagattggaaatataataatcatcacaaatcaatgtaaatcaaatacatgtatgtatgtaaacatttaataatacataaatagttctgtaaaatatataactaaaggaacttaaatattaaaaattaatgtttttatttcaaaataatttctatatccatttgggtctggacacagaaagcaaattattatgtatatagcaaaataaaaataaaataaaataaatgccctttctgaatatgaactttaatccttaaattagtgtaattttatattataataaaggtaaaataaaaatttcatataaatgtccctcttattaaaaaatggaaagaaatcaaaatgaagctaattcttttagaaaaaaattatataaacaatataatagatttttttttaccataagtgtactttctactgataaacatgtaaagttaaacagacaaaaatgaaaacagtaatcatcatgtaccaaatatcattttgggaaatcatattagaattgtttaaggcaaactacatttttaactcttgattaaaaataaatagtggcatctttgacataagtggcctagtttttcaaataaattattaaatataattaacaagtgaaagattttaaaaacgttacattttaaaatgtatctaaacacatataactaaagaaatggcatctgtgtgagagatgagggattccattttaaagatcaagaaacccacatcaactagggtaaaagctaatgaatcagtacagaatttaaaacttgattcaaagtttcttttaagaaatgtatcacataatgtcgaaatgatataaatgataattctttatattttgtaattgtttctacatcaggctaagatgctaaatcatcctaaagattggatattttgtaagtggttatgttatactaagagatgtaaaagcaaaagcttaattatcatgtgatgatcttttatcatagctcagttttgatttgtaacatttaatttcgattcatttagctataaaatattttatattgtattttgatatcttttaagcattacaaacagcattagtaatagaaagagattaaagttatttgaatacctggctttatcatgatctagaagtgctttgcgattcgttttcctgctttattaacatttatggaattctttgcactaaaatgtcagccccatagtttcatgaatcattgcaaaaacatcagggagtatcatttataatgtacagcaatccattttgatacatgaaagtagacctggttgcagtatgccatttttggattcgattttcatgtaatttgaggtaagtgctaaattatgatcttgactgatacttactagtgagccagtcgtggcattaaagtcgatatggatcaaaatgaaagaacagaaaagaaaggcattagaaatactttgatttaataaacaggttatacataaaattttgtattttggtatgctaattttaatacctggacttaatacctgaccaaagtgtactttcacttttatttccttagtaagtctttcttcaattatcttttcctgtatggtcaaacattccaagtttttttaatgaaaatttatatcatataaatcttatttgaaagttttagaagatgaaatataattcagaattcaggagaactatgaactcctatgtcaagtatctaaaaattaaaataattttaacttaattattttatgaatatatagatttagcatataattataattgcaacagttttctattataaatagatattctggtaatacttcttaacctaatgcaatccatcatgcatttttgaatggtgatttattaaaaatatactaaatattgtcttttttaagtgtaagatttcacatactacaaactgcaaaactttacgtaaaaattagagttcaataagtataaaagaatacatttttaactgagtaatttagaatcttttctatcataaatctacttttataggcatattaaaaatctaaatagcaaaggtaacactctgcaaataaaatggttaagagatatgaataaatcaactgcgtaaaacatgttgagctttccagaagagaaatgttaaactgttaatgttttattgtgaataactaataagctcacatctgataagttttccagctcttaatataataacttgtgttatgggattatcagtgatataggcccacaactagacaaaagatgtagccaaaaaaacaaatctataaattcacttgagaaagatcacaatgggttttgtgatattaaacaactcttttcaaactttcctttataaaatgtttaaaataacacttgttaatataaaaaagaatatgtaaaccattaacagcaaaacaattactgagtacaattaatccatcatacaacttaagataaactaaagataaataaactgaaacatttaattacattgcaagagacgaataagctggttttgacatttctgaattttaagtatcttctctgcctaaatataagctacttggtattttatttgcatctttttatacagttaaaactctctttgtttaagggttgaagtagtaacatttaaattagtgtctatttaatttaataactaaatccatcaaactataggcctattaaaacgatttcattttccttgctggttaatctaaagtgcttaatcttaaaatgttaactgtcaaaataatagaccttttttccctccataagaataacttgaatttcttacatatttcctgtcaatcattccatctaaactgggtgtgcataaattgttccaccactgtgactctctcttaagtttgtaagtttggacagtgttactcacccctaccacaaaaaggaaataagatcatattctgaaatggatttacatttctatgcttatagtcagaatgtatttttagtgaggggaagatctgttacacagtcaaataactgtttgagaaaacagagtattatggaatacatcaatgtgttagggataggaagtaaaataccacagaatttattaatcaatgttacacatacttcttccttaggtgaattttttgctactcaggccattaccttttgtgttcacatattagtaaaagctgcacttttacttttttttttcttttttggagcaaaaactttaataggcaagaaaaaagaaaggaagaagaaagcagctccctcgtacagagacgggggggtggatttgaacaaagagaaaaccccccaaagatgcacttttactaaaaaatattatcattaattctttgttatatatcctggcatcctataatgtgtatgactaagttcatgcattgacataagcaaacacagtgtttcattaatgaaaagaagactttggactgagaaaaagcccactgacattgtcagccagttacttcagtgttatattcgaggtggtttgatattattttttgtgtgttaaacacaaaagccaaaatgtaaaagtcacaggactactttaggtcttacaatccagagttacatggtctcaacagttgttcttttctattttaatttaaagcactaaacaagaaactattcactaagttttagagctgcattttaaacaggccagcctttgaatttctaatgtttttatgaaagcttcaataaaaagctgtggtttgaagtaagaacatattatagttttgtaagacaatttccagttggtataatgagaacccatataatctaattgcttaaccagtaacattcatttttactattatataatcacctatgttctaagtaaatttttattaaatacagttccaatacagatattaggaaacttattttatgctactgtaatactagaacattgtataagtgctcaaatagttttgtcagggcaattcccttccacgggaatttaaaaattatttgtgtcatagatgaatgagaaaactttaataataatccatgagacaataacacatacacacacacacacacacacacacacacacacacacacacaaatgatctaaaggtcttattcaatattgtatgccttttataaaattaagctgattctcctagattgtaaactgggatataattaaataccagagtaaaaaattgggacagctactggaattacaaaaataataataaattaaataaaagaatggtttaagtcctggaaaaattcaatctaatgttataattataaagatagcaatgtgagcattatataacactaataagaatactatgtaagttttacataaatagaactcaaaataggggcttaaaatatttcccaaatgtagaatttaccaggtaagtaaagtgataatttttaatttaagatatctggtttaattaataataataacttgtaactttaaatctacaagagagcctaaaatgggtcagcactggatcagtgttgcatagaacctgactttaattgtcattttaaaaaaatcaatagaaagcagtggttctcaaattctagcaggcatcagaattgggcttgttgagactcagattagggttcacagtttttattcagtgggcctgttatgtggtctgagaacaggcatttttaacaagttcccaggtgacactcaggctactgctaagaaggccccattttgagaaccactttctgaagtacagcataatgcgttcagcactttcttttataaagcctatcatcacattctcaaaagacacttattgactctggaatcaaatattaatgaatttgggaattacatgcaagcactatcattttataatcactaaaacatattttctgataactatggatacacgaataatttgtcctgggataatataatcatgtttcattataaatggtattatataacttataattggttatacagtaactattgctttgatgtgaaaaagtgagtatgttttccttttcctaactggtgcttccttagtctactcagttctgaaagactttccatactttaaaggaaaaaagagaaggcaaatctacttctagaaagaacttattactacatctgtgacatgtaagtatgttctggtgaagagacaacagtaagggcttgtagaaacaaccactttcatacagtttaatatttaatattaacaacatcctagtctgctccttgaaaggaggatgctgctttacattcctttgacttccccaccaagtctccaacagcctgaattgtaagaggtcccgtacatcatggatgcttcaagggcaaggtctgttaattattcctcagtagccccagcagttagaagaataccagttgcatagtaggtacttaagaaatgttgacagacctggacacaaacctcatgaatagtacatgcataatggatatttaatgatttactctgaaagacatcctagttcttttgaatatacaagttgctttttctcagcaagttcatcccttgctataaaataaaagatgggctagtgtaggtgtttgtatattaaggcagataacttcacaagtgtccaactggccttatgctactaagtttgcccacgtctatgatacaggaattttaataaaaatgttttaacactaaaacaagttttattgtgtactttttaataatttagatatgactttgtacacataaaatatatttttaaaatatgcacatcatcattgttacttgtaatataagctataggtttaatgagaatagaatggtgggagacaaattttactctgttatggctgtaagaaggagctttataacccagtactaggacttctgaggcttaaatcgacttgtatattgcccctaaaaatgtttctactaatttctactcctaaagtatattaatttagatattatctttgttttttcatcagctctgagaattgtatccaaaaacatacgagggaattaactgcatccattcagtgacaactgcaccattacaaagaaaggataggcataaaactcaatgaccaaaaagctatgaagcagttccctccttctctcactgaccggtaacccaaacacccaggaaaaaacaattgcagaatataggatatgtgacaggggtgaaattgcaacagcatcataagcccaaatgtctcgataaaactaaactaattttttcctaatataatatgaaagaccactaatgacaaaacacttgagtaatagaagtcattcagagactcagaaagaaagaaagaaagaaagaaagaaagaaagaaagaaagaaagaaagaaagaaagaaagaaagaaagaaaaaaagaaagaaagaaagaaaagagaagagaagaaaggaagggagaaagggaggcaaaaaaggggaaataataagagaaaaaaaagaacaaaaaaagaaaaagtcctactgctctgcctgtttttaatactgacaccccataaacaaatctgtccctgggatatgatacagaggcctggagtctgtgacctcctttctgaatctatcaggagacacagcccacaccaaaacaccaggagtgttgcttctgccaaatatcctttactaacttcaaagaaagaacggggaaagagctgtaataatgcttaacacgaaatactgcctttctgcttcctttcctttccccatagactgaatgaactgtcattataagacaacatactgctgagttaatgtaacttaaaaatttacagcaggttgtatgcctggaggcacattatggggccacctgtaggcatctaattccagtgaaaataataaataattgtggagcattcctcagagtctagagagagtggataagaatcgtgttgcttgttcactccaacatggattctgttgtggaggaggattagagaactgaactctctccaacaaatgagtaatccttctccccacaaaagagtccgctaaatgctacaccagacacctgggtgccagatctacacagccatttttgtgcacttctgataatccacctgcagaaattgccacttggcaattgcttaatatagcacgttgatccatttgaggactttttttaaacagtaaagaaagctattttgtttgtctctctgtatgctgtttatctttttgaaactcctcctcacattttggcaaagatagtgacagtaagaatatctgtgatatgcctccaatcacttatttgggagaaattagtatgtgtattttagcaatgctcagcaaccttgacctttttttcactggaaagaaaaataaatttactacagagctgctttttttttttaaaaaaagaaaaaagaaagaaaaggccaaaggatttgttatcgtgcttttgccacaaggtaggtgggttagtatttatcctgtgactactcagagtatgcatgttgtttattttagataagataaaatattctaagatagagaaattttacatatatgtgtgtctatacatatataacatgaacttttattaagcaggtttcaaaagatagtctaatttttgttcagttgggttataaattacttataaactttactaatgtagtcctcatcttacagccactgcaaatacggtttgggtttaaaatctatgacaacctttgatcataacaatcacatggtttggaattaagaaaactagattgaaatgatcatgtaagtaagtagtgaagattggatgctcggtggtattcaggttcacatttcctttccatttgtactacacgaagggttaataaggtttgcataaccttattctttgaaggctttttggcagaggcagactatttaaggattgctgccaaaacagattttaacccttttaatcatactgttaataaccacattgtgcacggtacagagcatactgcacataaggcaatatcactctgaacacagtttgacctgatacccaatcaaggaaaggttcctagagacgcttgccattttggttgctatggtgagtttcatattttgtggaaaccactgctagatgtcttaaaatagaactttgtcaagaaaaacattggtccagtggcatatgctggcagagcctaccaaggttgctcaaattcccttcctttgtttttcactctccccactggggcaactgttccaagcatcagcccactagtctggcaggcagagaatccagaaacttgctgctaattacaatgttgacaattcccaacctgtttactggcgccagcaatcaaaccgcatcctctcgagtgaaccaaaaagcacttgctggctttagcttcctgaggttccaagctggctatattaattactgttaacttaaaactgtatgttgtacagaagaagcttaattagctggtatgaggattaatatctatcctttacacaatttaaaacattttgttcttggccaaattatgtgaatccataaaatatttttctttggacaaaatattgattattttaggtgtggcttctcagtgccaatttttccactggattattttcagttgagcaagacaatagattttaaaaagttagtctgtctgtctatctacctacctatcttgggattatatctacaacctttttaaaaaactttagaaagagaatgaacatagttatttacagttattgtttataattaataaaataggaaaacctattaaatgggattaaatggtcaaaaggatatcaactttctatcttgatgaatttaaaacaaagatagttacaccatttttctagtgaaccctcaatgctatgatagaggaatgatttggtagtcatatggcacataatggtgtatgtatcaatgacaggctagatatacaatggtgatcccataaacttgtaatactgtattcctactataccttttctatatttagagtgtttagattcacaaatacttaccattgtgttacaatgggctacattattcagtatagtaacatgtggctgtacaggtttccagcctaagagcagtaggctgccatacagtctaggtgtatagtaggctataccatataggtttctgtaagtacattctaggttgttactacaatgccaaaattgcctaaggatgtgtttctcagaatgtatccttgttgttaagcaacatatgtacgaggagcatgcttcacgattgataagttggttgaacccacagtgcaaaatcaccttctcaaacccctaaattgttagcattgcaagtaacccagatgtggcagtggcagaccacaatgcaattttcataaatagcacaacagaagtgaacagggttcaattgcaaaattgagaattttactttgattctgccctaatccaagagctgatctgtccctgtttatttaacaagatatctttgaacatttaaaaagtgaagtaaaagtaaatataattttaaattgtatattaaaatgtgattttatttctgttatttggtatgagaacatcatggggtcactattatttaacaatgtcactttaaatttttcattgaatacactgcattacaaatgtttttgaatccaatcttttagtcaacatttgcatttggaagcttattaaactgagttgatgtaattgtgattaacatttcccttgttttactgaaatattttcaactagggtaaaaggtcaaattattcctttaattatgattcatcttctgtttctacattaagatagcctataccattttccaagatttaaaaaatcattagtacaagcacactagagacctttggaatctgttgatacattcacatctatatatacaatataagaatttttgaaaagtttagattacttgggtaaaatatcactgaatagtatgaaaaatataagaattattctcagataataggaagagtaatgtgagaaaaacttcaacatttagtgaagttttagtgtgatgtattagaaagaaaacacccaacaaggacttagaaaatgggttccaaatattatctgggtgtccatggagaagttatttggattctctgtgttgtgaggacttcatatgggaaacatgggaattgtattacataccaaagaactagatctgagatagaaatttataatgacaactaactatcatatgagtttactatgagcttatcaaagacttttgaaattttgtattccatgtggttataggaatggaaaatagtcatattaaaggcaaaccaatgatcaggtggaaatgttacgtatttggaaataaaggccaagttagacaaggacaaatgtgtcaatcttctctatctttatcatggttaactaacaaatagatttcctctctaaaatctaaatcaattaagtgaataggaaaaactaaactcttggtatcagtattttatatcaggaaatactgtcttaacaaatcctcctaggttactttacttctagagcataaattcaagtatcacacatatgttttctaatagaaaaactgttaaaaaggctgtctcttttaagccatatccccctaggctcaattttcagaagtctgtcttttcagactgatgttctttcttttatttgagaaacatccagatttcttgcctttctcaattttctacagataagctaggcttactttattcagagtttattgctattttaattgattcaaatttctgtatcagagcatgactttgaaagcaagaactctgggatacacttgtcactcatactgtgaaagaatccttctacacagataaactatatacaatcaatattgaacactacccatcacaacagggtaaacggtaccatataaagaacaagacctcttctaatgtttcctaagatttatattttttcaaggtgtactggtcccagccaccaggaatttcattattgttactttaatacatcaccaaaatctgcacattcttcactccagtccacatcattaacattgttacttgctatcattgtcccttttctcttgtcaaattcaattgttatctacacaaatcaccaaatgtaaatgtgaaaccgcctcaaaagtttaatgtcactcactatttttaataaacatagcattcacaactaacaaaaacctgcttgtttgtgataaagaatctccttattttgactctgttctaatatataatattaaaacaatttcaaagctgttttatggacaactacatccaacaacaaaaaggaacatgagatattttaataaaagtgtgaataaatggcttccaaacctcacactcctacccccagatatatatttgaaggcaattacttttgaaagatttgtagaatttttattgaacttattctcaaagtttttattttttaattaatttttcctccttaaatctctattctttttatgcttgcttccatttagcacacaaatcagagtcaaagttttcaatggacataatgttttatacccataattaaactgagaatggatagtatgtaaactatctgaataaagcaatagctgataaaccatattattttaatttttagaggatgggtgtattattttgtgatcaaaaagtcaatttatatttactataaattgaacctcccagagagtcacacctttcaaataaaattgtaacttagtctgttttcctagtaaataattttttaaaactaaaaaacttacacagatctttagctttgaaagtatgcctatcatagtaattattatattgcacaatgtgcatttctattgattacttcttaaaactttataaattcttacaaatatttatacatttaatattaaataaatacattaggtaacattcacatggactaaaattttctatttcaatagtagattgaacagattcttggagtttcaaaaagaatatcagcttgaaagcaatgttcccatggatttttccgttatttaaaagttatatcaaataatcagagagaatgtattttccttcttggcaaagaataactgcactattagtaaacaattaaagaattaaattttatgttaacattaaattaaacaaatatatgctgtataacaatcattttatataatagtgactttaaataattatgaaaaaatgtaaaatttatattcacgtatgccccaaaaggatatcactgctttcacaaaattcataaatattttgagcacctactatgtgccaaacactggactaggtattttaaaagattaaccattttagaagaattaaatatcctcgacaattattggtccttttaacagaatggaaaaaaaaaccagtaattttcatgccgttccaaatattgtaattgaatttaatagcataaacatttacacaaggagtaaacatttttagaggccaagtgttcatgttcattctttatccactacaatcatatacatcaactttgaatggagttgtttgtgatttggcctcattaggctaaaatgcttatgaagatagatctgcggtttgagtagcttcaaatttattatacagatgtacatatacgtgtactcccatgctaacacattagaatgaatctgtaaagcattcttttggggcttttttccctactaaaacttcaaataaaaaatgaagcatgaaaaagcaacaaatatttccatgtgtttcatgctttaagaatttaagtaaaaatcttaaggaccattttattatttaatactaagacaaaatgttggtgaatactttttaaaagcttctgtcttagttgtgatatcagttggcccaccatctttacatgaaatgaagtgtagaattcatacaaaaaaaaaaaaaggctttctttgaaatggaatcctaaagaggtaaaaaggccttaagcgaatctaaatctagcccttctcatggatgagacaagtgaagaccaggcaagctgtgtgataggtccattgtcatagttcacaacagaatctgtactcgaaaacagattttctagtcttattccaaagttctttctaccacaggatatacctcactccttaagtatcatgtaattgagggacaaaatgaaatttgagatttctccgtgtaagagcctcaattctcaaatttgctttgtctcagtaaacaccaaagcctatataaataacagttatggaaaaaaaaacatgaaactggatccataaagtaatcattctataactttaattcctgtgtagttatctgtaaaacaatccaggatatttggaagtcttatcatgatatatttctattacaaaggaaaaggtctttttcttatatctgcttctgacagaatagtaggcatgaccttcattcattcattcattcattcattcttcttggaatccaaaaactaatggactatttggcagatatataaaaaactattttaaatgagtaatttttagtttatcttgagacttctttgaaacagttattgaaattgactacactagcttagagagacaaaaataggcttcaattaatactcactcatgtattgaatacaaattttaaaaacaaaattgcaagaaatatcaactttccaattaaaatgtatcatttttataaaaataatcttttcagaaaaagtgtttccaaaaagcacatatttcattcaagtttacaaatagaccctactttcaaattatgcaattatgtcactattgtaatataatttgtcaactttttaaaaagcatattatagtacaaatttcatttgaactggaaacatagtattaatagattccagcaatatgtcttttttagtttgtaatttaactgaatgagattcagtattggttttaaattaataaaggcaataacccttatttaaaatctttgaactgcatgttttagaactcgtaggtttttaacatttggttctagtttgatctactatatatatatatattttcaaatactatgagtctcaaagggcttttccacaaataaagcaaatgaagtgttgtctttacccttgcatatgtattataatattttaattgtgttggagatcagactgccttgcttagctcacattattattagccaggatgtaacagaacccagaactcacaagatacagttggtaataaatttttaagctggtcaacaatacaaacatacagatacactgattttattgttaggctgcactcaacaaactcaactaattactgggtaacaaacacatttcaagaaatttaaaatattatatctttttagcttatgttttttggatgaactgcagtgtttcctcaactaaaatgtttattttatacaatcatgcaaaatgttttctagacttaaatgcaagacttgtaagtcaagatttaaagtataagcactaagataaaaatctgaaaacatttaaaaaacaaattgtactacaaagctatttgcttaaactctacttaccatttgtgtatatagctgtacagctatcaataactaaattcaatagctaaatgatttaaaagtctttaaatattctgatgtcattattatattttttcttcttacggaaaatatatccaaaagaaatttacttttaaacagtaagtctcccatgcagaatacactactttccaacacagtaagaacatcattctgtcatttccgtgatacaatggtagctgcacctgtacatattgacaagatggtgaacaactgtgatggccttatgctgtctttccttctatgtccttagcacttctcctctgtcttacataaaacacaaaaatgtttcccaatatacccatcatctctaattttgttgtctatttttaaatttgaaaatttctcatgactaatgtggaatataataagacaaaaattgataatagggtttttggaatattccttccatcaaaatgctacttcatcgttgcttgcctttgcttggactttcactgggacctctgttctggttctagattggcattgctctgacaccaagaaccacatcattctagggctcacaatggcctcagggaaagttcatggggttgtcataatgctctatggatctttaaccacgaataccatcaccactccccacaattttattcaagcaacaacatcagaacagaattcacaaatacaaagaataaaataagcaaattttctgaaaaatgcagtttctatcaagctacttacttgggactcagtagcaaatgaccaatcaagatgatgtttcttatgcttattaatgaatattatagtataaaattgaccatttatagacattatataaatttaaatgggcgacctaaaatatcccacttatatatcataaattgtattcataaattctgagtatttaagcaggatttattaaagtaaaactagtggacataagtaattttcacaatttgtctccctcctcctttactgtgccctcagtattgtcaaatgaacagcttaagctgaatccatgttccttttttcaggaaaaatttctatcacctttgtaaagcaaaagaaatattagaaaaggctgcttacccttctagtcttaggacatcaattgaaaagccatccaaaaattatgactacttaacactacttggatctagcatgaaatgcacaaacaagcattttgtacttctttaatcatggctatggacagtgacagggcaaaagcagtcattgactagtggtgacataatttaaaattactttttctgggaataaaaaagctgtctttaacaataaaaattaactccagtaatttcaacttaataaagttttaatttttcccactttcttatcttaaaaggtgtgatgatggaacattttcacccctaacttaagtaagaaccagttcagactgacacctaatggaaactattataggaaaataattctgcaaaggaaagaaagcaatgagataagtatttaaacaacaacaacaaaaatactttcagttaactatgagtagaggtttcctttagatttcatcactagcatttgcaattattccattctcaacattattcttcctctatgaagcaactgcaataaatttgcacaaaactgaatagaatagcttatttttcaaaagttcttcctcatctcctcaacaaatgccagagtgttacatcttctgtttctcacaaactctgtcaccaggacttcagctctctttcttcctttcaaatcctaaacacttattatttagccaaccagcatgaggccaactttccagagaccacctaggaactagagtatgtagcttctacttttctaatttcccaaggaaacaatgccaccagtagacatattgcattttgttaaatacataacaagcataatatttaaaagccctaaatcaccaactggtagatccctagagaaaaaaggtaattcatggaataatgaaggaaagaacaggagttacatattctcttgctggtgatagaatgtcgaatgcaaagacagcatctgtgttttctttcctacttcaactcattcttaaaatggactcgcccccgggagcttctgagaagggctccacccgttccctgcagacgacaatgttctttgagcgcaaaagctgtgagtatagataccctgggagtaattgtgggatcagacacaatggggtgggattaggggtaggcagagggtgtgtgtggagtacccttcactgggaatcctaaatattagaagaaaggcgaaaccctaggtggggaagcatgagagtgtgcctgcttccttcaagacacctcggtgtcagcctctccagggttcagactgctcttgtgggcaagagcccagtggggcacacgcacttcgtgcctgagaaaggcccatcctccagggggagaaggtatctgagatgtagctcagcttagagcggtcccagagcgacaagagggagagcttcacaggcctctaagtttatttgatttttctcctgcagtttccatttctcaggaattcagtcttcgtgcgtagcccgtgcacaaccaacgaccaccacgcagggaggaaacctggtcttagtgtttggccgcgctagtggaatcttctgggcgcctggtacgttcttgtccccagcactctgtccttccacctttgaagcgccttgataggacggtcccagatgcctcacaagaaggaaaggcaaggtgcaaagctggcaaagctgtgtggtccgacgctggcgagagctgagacctggagccccagcccacgccttccactctgggtcatccttcccagcttcatcttgggcatgccaactcctgccacgtccgattgtccccaggagtgcccaggcatgcttgaggggtgtggtggcggtggcttcctcttcgctaggaggtgacaaatccgtgttgttttatcgtccattaatatttgaaacaaacaaacaaacaaacaaacaaaaactctaagtagaaggagggagaggctctctcttgctcccacgccttcgcagctgacctgagaggggggacgtgccttgcgtttgttggtgtttgagactcgtcctaaaggcagaggcagggaagacagcgctgaagaggcgtcccaaagagattggacgtctgaacagtcactgcctgccccaacctctttcaggaaggttccaggtctgtgccacactgcaaccaatccggttcccatcctgtttctccaccccttctcggagaatccgaaaagaaaatatgcgttcctgagagacccgccacacttccgatctggaagttccgcggggacccagcccccgggcccccgccccctccccatctcggccgccaagtctggttgcggagcagcgcggccggccgggggtggggctccggcaccgccccgggctcgggattcgcgaagtcacgcgcttccgcaggcttgcgggggcaccttcgcccacggacacgccctttctgcggaggcagcccccagcgaccctctgcccagcttcggcgcctcactcgcgacgctcccaaactgctcaaggcctttcagtcgttcccaactttagaaaatcgccccgtccgcgtctctccctccagccgcaccccaccgtggagaggagaggagcggactgggaacgccgaaccgccccgcaggctcggggaaacggacccccttccgctccccgcccatccccttcacctcgccccccgccccctgcgcgaacccattttccagtcctggtcaccagaggcgcagcgcacagcctttccggtggaaccagtgcgaaaacacccgaggaaatgaaaagaacaagaaagtgctaccttggcaaccacgggcgtttagtggccagctggtgggctggggagggcggccgctgcccccctgccgctggtactctcctcgactacgcgtattcttaagcaataacaacgtaatccgtattatccacccaagaatacccgtcaccgaagagagtcagaggaccaagctgccgctgccgctgctaccgctgccgctgctaccgctgccgctgctactgccgccgccgccgccaccagaactcttgctgctcgctgagcccgcccctgcctggggatgggctgagcttgaccgggaccataaatccataactcgatttccctaaagaaggatccaaagctgtgctcggctgcttcctgcccaaatccaaatggccgctctatttccaattctgaaagacaaatcacaaaatcaaatacttaacacagaagagtgctgtctttccagtgaggagggaagatgtggcaaggctttttgggcacaagtgggagtgacaagtaaccttcagtttacctggtgctctcccagtgctttcctctgcacttctctgcttggtacccagtctggtctcggccagtccactctaggtggtatgattgagtgccatggcggccagagaaccctgtaagagacgtgaatagttacccacacaaatacaaatatatttgcctagacggctttgggaagaagtgaggcttaaataaagataggtcatgcatgggtgaaattttcagtagtgtgttttggaaatgcacttttctcaagcccaagatcatggaaaataaacactcattcaatttactacttgaaatcaaatacttatagatgtacaaaaataggcgtctttcctttgaaggccttatagctatacaacataatgatttttaaagaaaaaaaaaagcttgaaggcacacagtaattaaacccattttccatagtgtcaaaactcactgagttgacaagctggtagactttctatgatttaagcatcattttatatcactacaatgtttaatttcatagcacacttttaaaatatatactataaatgcattgctgtacagctgttgtggacacctctacagaaaaacctttgaagctctgtgttcataaatattattttaagaagaaaaagccaataaaaactcatttgcaaagtgactgtaattttggcattcagagagagaatctctgtgattctttgatgatcaatatggctcttactggaaaagctttgtcttaagatcctgcagtggatattctgataatgggggtttattgttcactaaataaaatggacaagtgcaacgtcactacccaagacatggtgtagcttccttagaaagttctcaatttgctttcccctttactctcaaatacatgaaagtacatccatgtaaggggaatgggggggaatatggaaacatggcaatagacattatgatttcccaaattatgtaagtgcaaatagctcttcatcaaggagtaattatataacagaatctctcccactaccacaactcatctctaactgacctggttgcaatttaaggtgcttaggttgtgtttgctcttatttttttaaaaattataatacttctccgggcacaccaactcatcattttcttgacatgttacttacagatggaaaaatcaacatgaattctaggttttatgaatagatgtttaatatataatgtctgaacctaaaataactagaaagaaaaccaatatagcccaactaccagactgttttacattattttcagataactcttaagtacaccacttacaaaaggacagataccaataaaacaaataaataagcactattttctgttgttacctaacataggtataaagtggagcttttctctggtgctagacaaaaaaaaaattcagaaagctgacaggttctcttcagcttgaactcctagaaacaaaagcccttagggaaagtaatgcaatagtctatgagcaaagtgtacatttgcttctgcactcttctatttaaatctcaactaatattaaaaggaaaacaagaaacacactatacagataggcttggatttagtaaatggaacgttataaactcaaaaggatggtcaagggaggcacacacacacacacacacacacacacacacacacaccccaatacacagggcatcagaatcacagcataaatacccacacagcttttcaatgctttccaagtagtctccttcagttttgcttcctcacaattaaaataaaatatatacacacactgacccacagactcgcacgctttaagaaactagaacaacgcagttgatatgctttctttctacccaagtagcagtgccagccttttccctacctacccaatgttccaccagcttcagcacctggacgaatggacagctcaacccgggccgactgccggcagcactcgcagcagaactgacgctctgagctctaaccaaagctctctcgtgcttgagcggggcagcctgacttacgagaacaccatttcctacgagaccactgccgctgggtgcatattcaattcaagcctccttaagctgtcggatttcccccacccatccaccctcccccccttctccaccctccacacaaaaacaaaaaagggaaaaagcccaataccatcagggcgtttgttgatcaacttacacttcgcttttgaatatttagatactgctagcggaacaatatcagcggaggcttaggtccgcattaagtacctttgttcatcgactcctgcaagccatgtttattagaatctacatttctctcgcgccccaataactagaggtgtgttttgcgggcagggggctttcagcaccttttgatctctcaaggccaccgcgactgattgacggttcccagtactttcctatgctatcccccatactccaacacccatcccagttaatcgcttcgcaatttgcaaccaaaaatacataaagaaacgcgacaaagcaatgggtttgaggaaataagccaattaagctaaagctgaaatgcctctctctctctctctctctctctcccccccttctccctctttctcttcccccttgactccctccctctccctctctccttccctctcaagtagaaagggggaaacaccaaggagagagaaaaaatcgggaggagggtggtagtcgactcttacagtcaatggaaaaagagtatacacatctttactgaataatactctcgttctcagacaaaaagaaacacatttttcgatgtaaacatagtctgcctctgccatacatcctacatcctttacgtttgctgagatttgtcttgctgtatggcaaagtaactgtcacaaatccatctcgattgaagtgcttaccctctaaatccaggtttcaagcggaactccaactgtgtgtagaagccagggagtcatctgatgtgcagtgaggtaggctctgggcagtgtgagctgcttcttctctccgagtgccgggttacagtgttaacaagccttgggaagggacctcggcgcctcgcgctggctgtgccccagtgccttcgcgtggtggcggcttgctcatgcttccgaggagtcccaggcgatagccttcagctgatgcgagcttccagaaaggagtggggaagggaaaaaatcatctaatgcaatcaaatcgatctgatctacaccatctgtcgcctgccactatacacaaacgttaaaataggaaaacggaaaacactgacagccgagagggttggtctgcaaagagttcatttttagcagagcataattcgatatggtcggcgtacagttacaaaagctgctgttaaccatccagtagtggatcccaaacatgctaatggtggattaattgaggaagatctgacgtgcaagcttcatagtctcttattcatgacttcccaatgggaaaggaccaatgccttgtgggactatggtaacatacagtcaaaaagctgctaagaaaatggctgtgtgttcacagcacctctctctgataacaaacatatgtcgactaaaatggtttagtagaatgggagggggtgttggagaataaaattttctttccccgtgtaagcaatccccattttcttttcttaaagaaaagcaaaaacagatatgatctctttaccatagtggggggaaaaggatgttttaaaaggtttttatcaagatcaaactctgccatataaaagaaacggaacactcctgtgcagcaattctttaaaaaaaaaatctattctcatttttttccttactgtgatcaaagtagatccatagcatgtgcagtatacagaaactcagtccagttaatcccaccaggattgattcaaggttgtttaatgccaggtacccttttgacttcttaaaaccaggatgccttttggggaaggcattttgtatcatttaaaattgacataatgaacattaagtatgattgcagtgaggagatgagaagagttttcctttctaattctgtaattactctctctagccaaaaccccttttggtctgtttccagtcttcccagatcagttgatggggaaatatagggatgggggagggagtggaaataccgagaaggagggaaagagagtgtggattatcgatagccaataaattctattccacttgtaatagaaaaatatatagcaataaaagagataactcactaattgttgatcgtgattttaagtttaaaccagttttaaaaaataatgtttgatacatggaaagaagacatattgcaaacaatgggatgactgccccccacccatttatagttataggtttaaaaaatattgaaatagggtttattatctagatatgtgactatcttttattaaatatatctcaaaattccatatttcctctgatttttgtcatccatttgaacactgaaaactatggtcactttgattctgctgtcttttctttggtaacatacattacataaattctgtagtaaacaattagtgttcaggaaaattctaaagatgaatgtgtctcctaaaactttgataatctctttaaggaaaaaaaaacctaacagttatgaattaaattagtctaaaaatatagcttgaagacaaatcaaacaatttacctgatcttttgtttcaatatacattaattaagcactctttccaacctacacaacattccagggtcatagtcagatattcaagtctaatagttcagcagcctttgttgtcattcgtgtcaagctattgccccctgcaggttaggctgaaagtgcaggcagaatttggccaagtcctcaggaaattgatggtacacaagttactcagtctctcccaatatttaactagagtcaactttttaagtttgctttcattatggtttaaactatttatttacagataggtagtacattaagaaaaatgctctttaaagatgtgacttcagtttttcttctgagaatttagctgcattgagtaaaccatccactttgttgtgatacaaggagcattttgacacatttagtatagttttcttcatcttcccttatccttattccataagatccagcaaaattaaaaaaaaaacatatgtaacaggattggaattatgaattctcataataaatatatagccctgggcaatttgatatcagtatgcttttggtagactcaatgaagtgtgtgcaaatcaaaccatttcagattctccctgctcctgatatgatgaggtcaattacaccatttatcttgattataaaattaaacattatttcaacctccatattcctgctatactatcatcctttcccacaatcaacttttccaaatagggcaccttgccaagatgaaataaatttataattgacagaatagaaattaaattacatcaactctttcacaatattagaaagtggagcaagtttatagaaacgacttcagaaggtttatggaaagattcttttattctttggaagtcaacgatgtggctattcacactgagttgtaaagaaaccagcaatggtatttccctattacataaatattcatctcattgagcagtgggatatcattatgtgaaatataatcaattctaacaccaaattagcaatcaataagaatcttacctagtcaaattatagtattatttcaacattgtatgaaagtagctagaaacatgaaccgcactttgtttttttaaagctattatgaaatgctcaataaagacttaaagtttactggcaaaacttgggtcttttttggaggattttttgttaccctaactactgatatgttttctggatcctccagaatggacatatgggataggaactgaggataactgtgtcatattttaaacaatattaaaaacacaacaagccaacacaaactaaaaataacctgaatacttatctctgttttattacattttcaaagcttgttaaatttcaagaggacactacatctatacattaagagctttgcatctacagttcattaacactcctgctccaagtaaagaggggatttggactaggttgtgagactattaattgcacaaatatgttgtagtcagagcagtgactggttgcctgcagcagccatttctagttgtctttgagtatgcgtcttttttttaaaaaagtcatctcctcttcaaagtcatatctcacatatatatgattatacttgattgtgtgtactgaagcacattgctattgagtcagaaattttcaagtatcttgattcaaatgactgtcaaatacctaagaacagagttgcttttaattagcatgcagaaaagagagatgatatttgacctgtgagtcttaatcaaggggaatatttttaagttctcccataaacgatgtagcagattgcttgcaagtgccttgaaaaacatagtcctacttctcctcctactatcattactattgttctaacaatttctaaaggatcagaacagagttctagaaaccctgtaatgctgttattgcccggaatcctgggttattaaacattcttatccgcagaagcaaaggaccatccaatcctattcatatgcatcctatgactcaactcagtttccacttggcgggctgtgtgtgtgtgtgtgtgtgtgtgtgtgtgtgtgtgagagagagagagagagagagagacagtgagagagagagagagtgagagagagagagagagttcatcctgaaagcgcttatgtttccagaggttttcaaatgcaaatggagtgggagtggtggtggccgtgatggagcgtactgtgtgggtgtagggggatttggggagagggtgtcgtgggcagtaagtttaaacaaattcaaggccattactaccactgcagaccaaaataacttaggtctgagagacccccttagaaagatacaatgccttcctcatctaaagggagctaataccagagtgatctcggcgctcgcgcagttttgagagagggtcccgaaaaccgccggaggccaggtgtcgcggacgggccccgggctaaactctcgtctggcgaagtgaagagcgcaaagtctccaggcccagcgcgccttcgcggggcaggccggacaccctagccccgggccgggctcgctcttctctgaagccctggagcgggcaaggggcaccattctggccacaggaactctagtttcagcagccgcagcccgccagcgctggctcggaccggggcctcctctgggagagtaggagagcgaaaaaatcaaccaccaccttggatttcagatcgaggaaaggaagccaaagcaaaggtgtggttacacaggacatccatagacaaatcgttgcctctctaagtgggcctgagctttgcggctccagaagcgcgaggcgcggttggtgcggacgcgggggcgtgggagtcatcgctctccccgcagccctggccgagctctctgctgtcctcccgagtttgggccagagaccacggctcactccctaacgccctcgcaaggacggctgcccgtcgggccaagggcgccccgggctggaggccggagcaagacggccccgcgggactcgggagccttggtaaggcggaggctcagaccccgttcacgaaaacgcctggctcctccaggatttgtcaggtcttaagcagctccgagaaggctccgctggctcttggggaaccccgctgtgcggctcacccccgtttgtctctctcaagctctcgccctcctcccctggtcctcccttctccagatcccctgccctgcccgaggtccgggccgcgcgggctgagcccaatacgcccggagaagagcgccggagccccctgctggccggacgcggcaggcgcggcggcccgctcggtcccctccgccccgcgggctctgcccagcccggacccgcctccaccctccagtgccctggcgctgggggcgtgctaaaagcaacagaaaacaaaacaaaaacaaacaaagcgccaaaccccactctcacctcttctactggtcaaaggtaagtgtgagttcagcctctccctcgtgcgtctctgacccttctctggttctctgggctgaggtctgaaggagccaaaaggggcccccctgaaaaagaaattatggccgctttttagaatatgttttccaagcatcaaaatctctctctctctctctctcacacacacacatatatatacacacacacacgcacacacttcaaacccacacttgccagtctggaagagcactaccgatgtgcatgtttctggaagcatttccttagctattggaggaaatgtttactaatatttcaggttgtagacaccaataattattctgtgaattggggagagggagggtaaaggaagacagattcctcttaatttaacccttcctcccgtatctgagtgtgaatcctactttcagtcccaagtcctagcatgggccgaaaagttttcattcttatactgaggaggagagagagagagttatccatttctgcgaggtttcctgtgttcccacccctcactatggaactggggaagtgattgttttgtttatctagacaattcatgacttagttttgtatggcgttttgaaactagtttaaccttgaaataggctatatgctttgagtggtacagtgaaataggctgtgtgcttctctgttctcaggaaaaggttgttagaaatcacaatgtttctttctattcaggcagccttgagttagagatgggcatagtatgctatgattattgtgacttttagtaaagtctgttgcctctggatgtttactgtctttggagaatgatagttttttaagaaaaaaattcaaaagcttaggcaaaaaataagtatagataggtctagtaagtgatcagtactattaatatttgcttctactttcttcacacactcttctggggaaagaagccaaaggactttttttttactgtccccggaattagtttgttctatctaggcaggatccacgagacaatcttttaaaatggcgtctgttttcttatttggtattttcaggtggatggcagaatctttgaactgctaataagtaaggggatggggctgaaatgaagagggatctggtatctttcctctgtgttcatcaatccaggagatctgaacaggtcgtaaagagttgcagctcctcctgaggataaaatcgcaattataacaataaaaactaacatgtgttgagtgcttattcgttgccaggtgctgtgttgcaacctttatcgtcattttctcatttaatttccactgcaatcctgtggattaggtactacgatagtttctcattttacagagaaggaaagtaaggattgggaagatttatttacttgaccaaggttataacagttggtaagcagaagagcaaggatctgaaagcaggcagtaaaagagatatcttgagaactcaggtttattgtattggattcagactggtagtaactaagctaatatttcaggtctcagtcttgtttttcataaagaaaagaagaaaatattttcttttcctgaaatgaaagcatttgatcaaagggagatatttgctttttaaaatgtttgttatgaactccctacccccatttcgcagatgagaaaactgagagaatgaatccatttagctaccatagcaaagtgcatagccaggccttaaaaccagagttgcagatccaggttctatatccattccagttaaccatactgctgaaacacaaaaagatccttggtttttctgaaaatgctaagcagtagatcattaacagcccgaatcccatatttctcagtgaggaagctttctttcaccttaattgtgaatacctttttatactgaaaggatgcaaatgtggaaatagggctattctcagtggtgaattaaatgacaaaaatggcaaaagactaaaataactacatcagctttgcttgaaaagcagttaaagcagttaaaaagatatctgaaaggctcgtctcagtaccaatttagtcttctccaccccccaagacccatcctaccctactccaggaaagccattccacattacatttatttctgctagcttttgttcacaaaggagtttaacactaacaagattttggtgcttttcatctccattcatatatttcttctttgcaacggtgaatggttacagtaaaaatgtcaaaacaaacctctggaatgaacactttaacagaaaaaaatatatacaatattaattgaccaaagatttttgactggcattcacattttaagacacacttatgatgtactgaagtaaattgtggaaattgatttaccctttatgttaaaggtagttcaggtccagaatatgtttcaaaaaacgattttagggttcctccattttcagtaaggctcaaagtatcagagaaaaccagatgaactgccttaagtcactgattgggctgcagcccatgtcttagctttctgggtcatttgtgtgcaaattatttggccacatggcctcctgtcatgctggggatctgcgatttttccaaaggtttaatttacttaaatatgattgttattgtcaagttgggatttttttttcttctcacctctcattaaaacccttagtatcaatatcagttttgaactattatgttatataatgaagcttgcttgtctgtgtgaatttataccataaatgcgttcacagatttttagacccgaagaagggctttttgaaatgatctagtctaaccctgttattttactgatgaataagttgatgtcctgagaggtaatacagaattctcaaggtcacccatctagtaagaggaagaatgggaactggaacccagattttctgtattcaagctctaagacccatgcattctcacagcatcacgtccctacttctttcattgtgagagattcagtcactcattcaacaactagttattgtcatgaacttggcaactgttctaggcattaggaattcaacagagggaaaaataaaacaatcctgaaaaaaggccttcatttgttgaaacatattctggtggtggagtgggacagaatcaaatggcagtcttaacagtggctataaagacattttataaagacatttttcttaaaaattacctttaataggttataaaattcaaagcagacaaaaatatgctgatattcttctgctttttctgttaaagaaatttgaggaacttataatgaaaccaagtaatgaatcactaaataatgaaatcgccaaataatgaaatcaccaactggaaattagaagtaaatggtcatagcaaaccctaaccaggtaagtagagccctctcagatgatccatccatggaccaaggaagactgtttcccagagtcttcacagggtctttctgtgaattggggattaaatgcctttgagaaaacatagacttgtacaggagctgggataaagatataaaaaagagatcgaagaggaaattatttaacaagatgtttgacatattttcaaatgtatattagactgtcctagcagatgaaccaaagagcaagagagcactatcttgagtttaaggcagaagcttcaaggcttactataattggtttttgtgattaactcaacttttcccttttagaatatgatatacggtagtcttccctcatcaatggaataattggtgagggaaaggtataaataattcaattctgtaaaatcttgggttttgtgattgtgagatgcattaaaaacggtgttttttaagaaaatagaactggttattacaaagagaacatacactgggcattgaaatgaaaaattatcaaatgaataggatgtagtaacttccttaaaactgccactttcctcacaagaatttttgcctatcaaggtttggaccaattgccaattgtcttatatccatatttgccacttgagaggagcacttttttttcctagtgttttactgtatttgacttggcaatgaaatgaagctccctctcggcaaatatacagaatgaaacttttgttaatttgggacaggggagaggagggttttgtctgatattacaagggggaaaagtgcatttactccactgaagtttcttttgtactgttttctgccagtttaatttttattttctttggagttctgatgatatattaatgtaacagatatagtttataatataatgtgttaatagtataatagtttggctatttcatattttagtattttacatgttagtcatgtaacacaaaacatgtaggcaggactggttgaaagaaactattagatgattactacatagcgagggccacccaagtccaattcactgcatgtgaactgttgaagaagttttgcagaatttctctttcatgttgtcagatgtcatgtggtggtatcaaccaggtaaatgattaagttggattctctggagagtcactggtatatttcctgcctccaagcatatctgaaaccaagctacaactataggaagtgttgaattgcagaaatgtggtcgaattgttatctctactacctgtattatggagattagaagttgtaagtaaagaagtctgggtctttttcaacttttttttgccctgaggccggctgaagaactaatagcatcctctcccaccatggtcactgaaaaaagtagcaaatcttaaataaaggaaaacatgagatctgagatcttttcgatctgccttaagattggacagagtttacggaataattatgttgaagctcccaaataatgtgaatgaggttatctttctgaaggggtgaaagggtctttgtgacccacattccttttggagctaacctgctaaaaaaagaaaagcagacagacagaaagaggaaaacaaatcctatttgagatggaggttgagtgacaagagaaacttttagccttcagatatgtttgctctgcaccaggtacataataatatggtttttggatctttgaatccatacttagctaggcattaaattctaggaataatctgtttatggaaaataaagccatttctatttgaaaacaaatggaacaaaataattatttttccccaaatgtgtacccttttaattgatcaaatgcatccaggaaattctgctggcaatttgaacactgtaggtgttgttgcagctctaaatttgtctgcaagaggaattgtaaatggtatttaccttttaattaaacaaagcatcttgcaaattaaacacatgttcttgcacatcaaaatttagttaacatccttttcattgttcatcctgctgacactctgacagcatcgtgagtccacacacaatatagagtcatgctgctccccccttccctgcactttgcattcctcagagtagatgatatcacatgctagagtaccctctgtaactgacttctaataactgagcagcttttcccatttaatatacttaatattgtgtaaaatatgggactgcattggtgtgtccagaacctggaaagctttggacactgatctgacatatgtcttataatcttacactgaaaatttgacagtgaatgacagaacaccttagaggaatataagaaactgataaaggcagaagcactgcacgtgaatgcagagtatggtttctaatagctacatacttttttacatgcataccagtaatttgacatttataattcacggtggagctgaatttctgtcattttcttactgtcaagtcctccacattttgaaataaatgtcccttctaattattatacgaatttgaactccaacattcaattttttcccctgtcccttataatggagtactacatttagctgaagtctgatttgcaagaccagttaggaagtgtgatcatttcaaacgtattcccacaaactatacatgggaacccctttcttgattgtagtctgtcttacttataaaagtacagtttaaaacccatctatcagtactatttctaagaaaataaggttgctaatggcagaatgaaactgagataattgggatatggtcttaatggaacaaaagtcagagagaggtttttcaataaagcaaaattgtcgttaacgactgtcattcagttgcaccggtgctcattaatctcttttatttctgtttatttatggtttatataattgaaataaagtcatttgcttagaacattgccaaaggagaaatgtttcctgctttgaaaagagacaactcagaataatagttaaataaaatccagggtgaaatgaagtcttccttagcattatggtacctctgagattttccttttaaaagttgagggattattttcactgttagtgtttacttttaaggttcaggcagctagcatgttgaagagatgctactcatgtcagaaattgctttgaggcacagaaatgattggtatggatatgggtggaagagagggagggcagccctttagtgtcatctgaaaaaagctttcgttcaaaaaaataaaatacctcatcctaaccaaactttaaaaaacagaagtaaatgataaaagtacactttttgaaaatactgacttttatgttttaaataggtatttaattattttcagtgggatgattgttgtttgttgattaaaataagcttttatgcaaaaaaataggatgtccctttttgatttcaaaaaatgaacagaatgtggatgatgaacacacaaataggacttagaatcatcaaactaatttccctagatttagataagaccaaagattagagactttggttagtcactaaattttaaaatattatttgcatttataccagcataacttctgttgccttgtttaaacatttcacaatttaactggatacaattttccaactatatagaaaatctatgccagccaacaagtttcagaaatatcgattggaattttcactgatgtgtaaaatgtgcctgaactctagatgtaagattttccttttgaaaaaaaaatttgaagtttgatattgatccttgtgccacttggttttctctaggcttatacaagataaagcaatgattaaactctttgtagaaccatccaatgtgtataatttttacagttgatatgtaagacttcttttagagtaatttttatgatatatttaataatgtgatcccaagatattttgtatatcaatttccagaaagataaatgagaatgttttttaaaaataagcagaactttcatcattgctgacaaaatggccggtgcctctttagttcttgctaaatgccagtcactgtgctgaatataggacacatcttatcccgttgcatcttacagcaaccccacatgaaattactctgagagaactaagactacagagactgaaatgccttgttcaaagtctcccatctagtaaaaaaaagtagagactggtttcaaatcaagttctgatttatgagggaaggctcttatatacaacgcagtgtggctttttcacaattctcatttatggaacacttaccatgtgtcagatgctgtacttaatactttacaggttgaaaatgtatcttgtttagcaccaaatctaaatcatagatctaagacaaagattttgactaaaaggcacttctgagcttaggctaagtgtagaagtggaagggtgtacaggtaggttcaacctaaaatgaaacagcaaagtgggccaatgtgtcatcaactccttttcctatctacttccattcttttcctcaagtttgcttctcatttctatagaaccaactcatggaagaagggactcctggcaaaatttgtgtctgactaggcatgtctgaaaaactaaacagaagtcaagctttaaagaacaagattcatttgtgcattcattcattcctttattttattttatttttgagatggagtcttgctttgtcaccaggctggagtgcagtggcgtgatattggctcactgcaatcttcgcttcccgggttcaagcaattctcctgcctcagcctcccaagtagctgggactacaggtgcgcaccaccatgcccagctaatttttgtatttttagtagagacggggtttcaccatgttggccaggatggtctcaatctcttgacctcatgatcttcccacctcagcctcccaaagtgctggggttacacatgtgagccactgggcctggcctcattccttcattttaaagtatgaaagtgatgtgaggaacagagaaaatcctataaattacatagttcaaggatgggaaattggaagccctccaaattgggctcacatatgtggttcccccccaccaatatattatatttcaaaaaattgaatttgaatgcctttagctggggcatagagtatccagtacagcatgatccctcaccactcttagcaattctcatcctcgtttcacatattctccacttggttcttaaaatcatccggagttcatgactatgttggagatatcccaatactgaaagtttttgagaaggttaactcagaataagattatttctccaagtcaatgctgtctttttcttttcaatgcctagttcagtgcttggtggataggaagctcaataactagttattgaatgaatgaatgaatgaatgagacagattgactcctagcatccaagtgtcctctatcccaatccagtgtttgtttcattttgtcacttaatcctcaggaggagtggggcaacgtctctacttttttgtgcaggaaatttagctctatctttcagcacatgattgtactctttttgcctaaatcaaatgaggccgaaactaacagcagttcagccaaaggagattcattcaaaggttggcttcaaattgaaatcatgtaaaaacataacaaccaaatgtacagtactttccagaagacctagaaaatcacacttacttccaatcaagtcataattcttgatgtagtacattatcttcatccctgtgattgaaagggacagagacgcgtcagacaaagtagatatctctgccagacatatggagaatgtttctggagtttgtagaaacctttagattgaaccaattttatgtccaaacattcagaagaaaaaagtgaataactgggccatttatctttctctatgattaatcatgctatacccatatctggccatttagaagaaaaactatttctttattcagcattcatgtgtatatatactgtgatatagcttagggctgattcttctgttattgttattgtgtgtcagccatatgactactctagagaaccttgggttgctcattaggataattgtgtagagtaatagaaagttggtaattttgatcaggaaatcaagtgtttttaaggcagaaaccatgttgccacaggaatgatagataaacttgttgggcatgtcagttgtacaaagtcaaggcagactattatgtctagtgttggaccaagacagaccctcatatgccactaaccatttgcatgatcaccacattccatacttcttcaaagccttcaagactctgtattttctgaggaccaatttcaaaatcctgagcatatcagccaagtctccccatggtagtgctcaataagtattattattattattattattattattattattatttttgagacagagtcttgctctgtcgcccaggctggagtgcagtggcatgatctcggctcactgcaacctccgtcctctgggttcaagcaattcacctgcctcagcctcccgagtagctgggattacacgcatgcgccaccacgcccagctaattttctttttttttttttttagtagagatagggtttctctatgttggccaggctggtcttgaattcctaacctcaggtgatccacccgactcggcctcccaaagtgctgggattacaggcgtgagccactgtgcccagcctcaataagtatcttttgaatgagctcatggatatttgctgtcatacattgtatcctgcatttatccagtaattctcaaagatctctaaatcttgtttttgttttttttttctgactacaagacttttcccataattctctggggaagccttttctcacttgagtcatggcctatgcatctgtgtaactttctgttactgttcttgggcatcctctgaaaaatttgaaccaagcaccatctcgtctctattatgctgcactgcactttctctgcctctgctatggcacatatcagattgctctttacctgttttataactgttatttgtatgcctgtattacctacattatatatgctaggtgcatgcttgtgttaccatattatagctcttaggtacatacctgtaccctaaaaacatgtgagtggtacgagaaaagggatcatatatttatgctttccatggtacattttcaatgaatgttcgagcagtccgccaactaatcacactagactgcttgtataagaaaacaaaagaaaaaaaaagaagagaagaaagaaagaaagatcgattgatcaagggaaagtggtactatcttttgagatatatccatagccctacaattttttttcagtgtgactataaagtaatacattttctcttttttcttctactttttaattttacttattttcaaggttcttttttgaaacaaactatgaaatttacacagcaaatgtcatttcacctttcaaaatgattatatttattctgttcatgttgacattgctaagactttttttaagattgtcttctggaatcatttcgaaagtcagtctcattattttgttgccaggttactttttgttctcattttggttcattaaaaaaaatttaacccatgttcaaaatttgaagatttctaataattgaagcaaatcctaaatgccaaagaagggtttattggtttaaaaaatggcataaaattcttacagagaacattatgcagccaaaaatattatgacattatgataggaaattaggaaataatttacataaacattgctcattatcttttttgtatgtgttgcttgtgataatttttctgcttttattttaaaaattaagcctacaaagaagttgaaagaataattcaatggacactcagataccattcaccttgatttatcaatgttacattttatagacattttatctgcttgtctgtttctctttctgtttagattgatagagctgatgtgtgtgtgtgtgtgtgtgtgtgtgtgtgtgtgtgtgttgagtaaaccaacaagatttttcttcacctttacagtctaatggctaaaaaaaaaatactagttttattagagtttgtctaggtgatttcttcaggtacatatgggccttttaaaatatgggagtcatgtctttatctattttcaggatgtttttctctgattttaattttatatattaattctatttcattgttttgcttttttatttttcaggggattatattatttctatagtagatgttctatatttactttctatgtcaactacatttctctgatttttctctttgttttcattggcataatgctatacttgcatttttttcagcatttcttataatctatttttgttgttgttgaattaattctcgcttgagcattttgttagtttttatttccaagatgatttttgtctttttaagaatggcttttgttctgaatgtcaattcttatttcatatcttcatgcttttttgcctgtttctgttttgaagtttataaacttatgatttaagtttttctaaaaaaaattctgtaaattattttttaaggatatttaattcagtttccttatgctttattgtcattttattaaggagaatatatgctgaactattttgatttgaattttccatttttcttgtaaaatagttttgtatgaatgttgtttgacattatctttctaaaaaattttaaacatgttaattttcttagactagaaataagttttatgtagacaaaggagatgtgcttgcatggctcattaggtttcttaggccaagagtctttcttgtaatatggtgaaattgattttctttgattgcatttatttttctcttgggtagggggatagtggagggctgtgtgttttgattttgtgactctttttttgtttgtgcagactccttaagtttcatctcttttttccatattttcctgcactctcaagcttccaagagcatcctctgcaagttggtattttccttgcagaagtggtgctttcctagggacctacttcttgtttcatgcactttatccctttcctgttgatttcccagtctatggtgctctgatctatcagatctcagacttgttcttatatttcctcatctcaaggttggactttctttttctgggccaggggatggggggtaagagcattttaactgtgtaccacactggttagctaatgctccctctgggtattcatgtgtagaatctgtgcttgatgtgggctcaggagcttcctctgctagatttgggcatttattttcatatttacacagaattggaaacttgtagtggtccttctatcctagttattctgcaggctgggggataagtggttttacttactttctttgttgttctatatgaccctttggacatagtgtggagaaatgaagatttactttactacattatactacaggaactgagaatgcctcttgtgacacatttgttcttttttgtttgttttggaatctatcagtggttgttattggaaattttcttgaaaaggaaatgaagagataatattggatacatagagcaaaacttgatacagatcctcatgactcatctgtctcacctgaacatgtgaatttttttttttaagacggagtcttactctgtcgcccaggctggagtgcagtggtgtgatctcgactcactgcaacctccacctcccaggttcaagcgattctcctgcctcagcctcctaagtagctgggataacaggtgctgccaccgcgcctggctaatttttgtattttttttaggagagacggggtttcaccatcttggccaggctggtctcgaactcctgacctcgtgatccaccacctctgcctcccaaagtgctgggattacaggcgtgagccacggtgcccggccaatattttttaattgtaaaagaaagcaacagaatggtataaatagaacactcttttttattaaaaatgtgtatatttgcatcaaaaattgtcaagaaaccagagtacattaatttattcactctagttataactggatgggggattatatgtgactttttaaccttttgtataataaacattagattacttaatcacaaaaaatagagaaaaacatttctactttagaatattaaaaaaaatttgtcataattcaatgaaattcaacagaggttttgcatttctaccataacagaaatcacactagatactgcattatgttctaaatgaatttagaatatgttaattaagtgaattataattataattaagtgaactcttcatgcatacatatacatttgtatacacattcaggaatatttgtgtaaaaagttaggcacatcacacttgaggagggagacaaaaagcaatggtaggaggcacagagagtgagtccccagctaggagtagctggcctgggaacagcctgtgagactgcactccctggcagaatatggtcaccaggtctgggtatgaccaggtcctgattcagcagtaatgggtgtactcaaacattcccaagtaatctgtgaccttttccttttcttaagtagttctgatcaaggtaaagacatggaatttggaaggaagagaataaaaactgggctgaaggtagatagtgatatattgtgaaatacttgtgcaacatgatgtttaaaatatttggataatcactgcaattatgtcacaggcattataacattgttctctggcaagagcacaatggaagtgcattgaaagcaaatgaaaaaggcaacataatccaagtgatatcaacctttatttgctagtcttgaaagttgtggttgaaagtatggaaacaggggtagtgcagaagttttttgtttgttaatccaaaaggcactgataccaattattatcattattttactttattgagggcttatcaatttccaacaagaagatgtggtcatgtattttccatttcataatgccaatggagtatactattacaattatgcaaatattcattaagaggtctccatatgattatgctagaaatgccagtacattttcaattctgagtgacaccatacatctgggcaaaacaaatgtcagtttaataataataaatattattacaaaagctctatgcacttataatatctaaatatatggtttgaaaagtttctggattattttgtttttaaaaaagtgtctataaaattgtttagagtattcaactgatttggctccactggggctaatgccagtcccaatcttcagcgcttataatttgtactgttgttttttgttaaggaccataaatgcttttagtcacatggttttggaatatagttaatgctatgactataaatgccttatgtaacagcacttttagagaagttgctgtttctatgattccatactatcacaatagagacataagaaaagaatgtggttaaagagtaatttcagaagcaactagaacattgaatttggagttaaagtacttacggagaataagccttttatatgcaattaaaataataataattgccagtgacttatgggttagattcagttaagaaatctttaatccaataattcagatataacaatgtgcacacacacacacacacacacacacacacacacacacacaccgtttcagctagtttaagcacagaatactttactagagaatatggatagatcacagaagtgtttgcagggctgaaaaatcagtgtctattcccagctttcagaaatgactacaaagcacagcagaagccagaggactactgtgtctgccactcacaggaattagcaaaattaagaagcctcccctcatgactgctgggtccagcacctcactgttactgccttgatccacacaaacaacctggataggtgccttgcatcctgcttctctccttgtttccctgcataactcccacccaaatcaaaggggaatccaaatcacatctggagcactagctacaaggggatatacaataagccatttttagtttctgagcctctgatgctgcaggggagtggaatggggtgtgaaaaagcctatgcaactcttataacgtcaaacaaaattaggattatgctatatagatagtgttacgtctggcatttttcagtttaaatatcacactcatttctcacatcgttaaataagttatgaaatcacatatttgaatggcatgattgaatttattgaaataacatttaaatcattttgataaaataggtccagttttgtaaattattagaaccatatagtacctagtgcctagcaacgtatgatgcactcaatatatatttgttgaatgaatgaatatcatttgaggacctgggttgacaagaactataccatcttaaacacatcattcttactcatattaaggagagaagaacctgaagggatgtttagggagcttcatgggccaaccttgtaagtaacagaacttatgcataacaatagcttcggctggaagagaagctattgttggagagaaaaatcatgaagccacattgaaaggcaaggaaagggaggctacaaaatagtgttgctgggccttgttacaattctgtttctgggatacaaattttataggacagtcttcaccacagcatgagaaggaataaaaatcaatttttctccttgtctttagggccctttgcaattggattttcattggttaatattatttttgaaccttctaattgttcacaatgtatactattatttttaaatttaacaacattttttttccagaatgaatgaacaaacatcaagtggggacatgatgtatttgaaatattttcattacagcaattggtcatacagtttaactaaatgagatccctttcagccatcatgatatgtgcttttcaacagacgcacaattctgttgagacagctgaaataagactaggtctgtgagcatccagatagtccctgttctgtttgatatatagaactggagtaaaaatattctttctaaatttcctataaggagtcccctaaaatgcagctgactggtttatggtcctctcatttcacttaccttgcaatctgatccagattgcctcaccaactgctagtagcacacctgaccaacccattgcctttccagttcttcctaagacataggcaacactccttccctgttgtttttactgtttatatctcttatcattagaaaacttgtaagtcctgtttaatatatcactaactatattattgctcagaaaatgactcctatttctatgcctctgaaatacacacacaaaataagacaaggtacgtaagcttgacaaatgttgactttgactagagagaatttatgtctactgcattggttgagataaattagacctaatcacaccatcatcgttaattttcttcctaaagttttaaatgataacaaatcagttaaaatgtgtacctactctaaagtaagcaactcagtcttggggctatttacactgtcaaagggatagacttttcaaattatttatttttatgaactaagaatagatcttacagaaataaagatgtatatggaatccatggcaaaattagattcatcttagcaaatgatcacttgattgataattatttgtttgatttagcaactaaactggttgaccaaataatctattggattaatttgtattcaattggccacagattatagttacttggaagattagatgtttagatctctttctagtgatcgatctaggcaaaattaggttcttttccccaaagacaataaggcagatcattatttccattatcagcagcttcaggaagaccttaattttaaattctctgagaaaaaattaaaaaaaattaataacaaatattcttcactgtgtatttactagaagccaaacaccatgcagaatctttattgtttcaatataaaaagtagttgctgaggaaaaaacagtgaagacaaaaatgcaagtctttggagtatacatcttagcaggtagaagcagacacaaaataacaataataagtgaattatgtatcaaatttcaatgtaataagtgctatgaataaaatagagcaaagtaagggggaatagatgtgtcttgaatggggctgaaattttatcattgaatggtcaagataatattaaatctattggtagaggatgacaattaaagatccacagactctctccatctttcttgggttctcgtttaccttgccagctccaaagtttggtatcactgggtttgcttttactgtttaccatctagtttgattagagtgccttcctctgtctcaggataagcatgtcctttccatctggcatacagctttacccttgaagctcagattgaagccattcttctcaaagccaactgagtcttggctcaaacaccatctcctatggtctgtccagagaaatttccttccagcctatccttggttcagagcatacagctaaaagaccaaattcatctgaacatcttactttctctttagccctctctttactttctcaagtcaataaagttttaaaatgaaggacgggaattaagtaaactacttttattggcaactcttctgtgtcacaggatatgatgactactttatatttactccgtggaaaaatacaaagaagtaggtagtattatttccatatgtagctgagcaaaatgaggctcagtaagatattgattcaaggacttaaacccaggccagacattttttttttaaatgaaaaaagttgcttttacaaaatccttttttccaagctcatcatcccaattcctagacacccattttacctctgcagcttcttgagaaaatacagaaatcagatatttgtaggacctgtattgtttgtaacttttcatttcagggttagatttgatatttttaacaaaatgcatctgaatgtagaattgtaatttttaaagattatgaaggtttttatcaagctggcattttctgattttatattccccaaaatattttaataatggtattattataatctccagtttacagtgaaggaaagtcaggttttcaaggttacagataatgcccaggtgacatgtctgaaagtggttctgctaagatgatgaataagtaaaactttattttaacaaagtgttaaccaaaacatagcctccccaaattgaccacgcagagaaatgttattgtttagattttgataaaacataatggctacaactaaagaagaattttaaatgaaaacctaatgagaaaccacatttggctttcatttttattataaaactttggaaaattaatatatttgtattgtttcaagtgaaatggaatcttaaaaaattaacaatctcataaccacaggtgtcaactaacatacccctgctattccatggttcttttcctctttacacttaaatattatttttggcaaacacaagcacacagacacggatacaacacacatcaaaaaagaaacagcttttaatataaattaaactcaaatataaaatatgcccttgtctaatgaaaaatgaaatgacatattttaaaaactcttcttttaatactttaaaaatgtgaggtttgagcatgaatgttgctttaagaaaagtactcatgttattacaaaaatagaacttgtgcctgtgatgttgcagttgccatggttactacaaatttgttacttaatagcagagcaaatagattcataaacatgctaattatatctgatacatttttcaaactgttttatatgaatatgcatatagtttgcataaaaatgaatgtccccatccaataattttgcatgtttgggaacgttttgctgtgttctcgataatatgatatatgaccatctcgatacaggaaaaaaagaaaatacaattttcaggcaaatgattttatgattcacagggtgagtgactgttattgttaatataaataatgtaacaatttataaatgctaaatactttaatattcacttagtccttggaagggttaaagtttgggatttataataaagctctttttaatctgtaattcctttttaaaaatatcaaaaaagaggcaggtatgacaaagggatgaatatagtgctgagtttttgacatgaatcagcatgctgtaaaatttgcatatgaagatgaacaaatgattttccaactaaaatgttttcctctctatagcttcagtatttgagagagctggatgcacattgaacattgcaaaaactcaaggactctgctctctttatctaaaaagcaaagccaccaccataatgagaaggaaggaaaagtcctatgcagttacatgaccatgacgggggaaaacttggcctagattacccattgagtgagcctaggatattattcaaaatcgacgcaagaaagagggtgtgacctttcctgagaaagatttgcttgggagatttgtgacttcagtcagggccttatatagctctctgatgaaagagagggaatatatatttctctagagagttacagtagaagggggctttgccctaatcttgtgattgaggatgtttccaccatccatttaaaacaatgttccacttttccttttattgacgctgtcttttctctcttttaatgaggctcttagtaagaatactatcaattggtttcactcagaagccaagtgatatttagcaacatgtatgatattagcaatcagccacttatttgtttacactacatttttcactttcacaaccaatgcacataggatttggttgctatatttcagaggtttgagcatgtcagggatactgactgaaaaatctcctctgcagctcactgttgcctagtgattgatatcagctgtaacaagataaaatgttatggcatcataattctgtttgatgcaaggtaatctttgatcttttactatcaacagaagattataatatatacttagtgtgataaataataccctttcactgatgtcaaagaaagtgcaagttaaattgttaatgattccaatagctagcattttagttgcaattttttaaaagattgaacaccttgtaaacagaaagactagagtcctgaatgtattattgttaagctattacaacttctacttcttaatcattaattattttctcttcaaaactgaaccaaagggtatattttaaaaactgctaaatgcatagccttgaggtaaattttcattggagggcatcatgtcaccgaggcgccaattagagacattaattcaccaaaagattatgtaaattaaaaaaatcaggaattgaacatttgctatgtgaaatactctaagtgtgaaaaatatcttcctatcttccttctactttaaaaatatagtctaaactcatttcttaccacatagcaaatgcatgctagatgttaactcttaatattatttttatcattatttattgaagggctttacatatgctgtgatcttatgatttacttcagatgccccttgtttacctagaaaaattctcatgtttcaagatactgctcaaatgccaatcacttcctttggagaggccactcagtgtatctttctctctccttcagaaaagagagtcgttcctcctttctgcttccttggcaccttggctgtgatttcattactactgtttctccttgccttggaatgacttgttgctttatgactttgggcccctcaggccagggagcaggtctagatcatctgtgtcttccacattctctaggaactcaatgagtgtttgttagttgagttactgaacatatgaatgagaatagcatggggtacaaaaagtaaaaggcctgaaaaaagaaaaaaatggaaaagttttcaactgacaaaagtaaatgatcctaaaaagaaaacacaaagtctatttctggtgttaatcatttctgtctcaaacattacagctttatggacatacagccaactttcaggcattgcattggtttgagaattatccaggcccctcacttttcctttcctctggatattaccagttgagcatttgtaaaaacctttccattgattcctccaacttgatcctcacaatatcattgtgaaataattaggacagatatcctcatcccttttttttagagtaggaaactgcagctcagagaggttagtggtttgcccagggtcacatggctaggaagccaactgcaaatgctctggatatcagactccagatagagggcactttctcagagcccacaaacatttcctgaggctaattacaaatattttgattgttcaggaaatgtttatattcaaaatccttggttaacatttgggtagctacaaaataagtagattcaatgatgtctatggtagaatggaatattagacaacacgtttcatttttagttcttgctacttaaaatgatatgaagacattaggaaatggaaattctgaaaacttggtgcaacactttccgtctgtatttctgcagattcctttatttggatttattgtcatggctagggatttttacaaataatattctctcaaataggggaaagtttaaaaattctctaagttcatcttttgtgttaggtttgtacatacaagccagtactattcacctgatcatattgtattaattcagcttgtaaaagaaaagtatctttcaaactagcagtttcccttatatgttttccagaatcattgttctgagaaagataagaggtatcattgtttttagcaggtgagaatccaggctttctagacagttatgacccatattctaaaactaaagctcaattaatttggatctacaattgctgtcagctatagtaagttagaagcataaactttatagctgaggtgacttaaaagattgtaccctaaaacttaaagtataataataataataaaaagattgtccaatgaaactttctctgtttgcacaagaagaaattgtggactagacagcttaagaggttcatccaatttcacatggttaatctgttggtgtaattaggacttgaacccagattaccatctgccttttcagtattctttttaccaaaacatactgtcttttttggtggatgtattagttatctactgctgggtaacaaatcacctcatatgatagtggctggagaaaactgtagccattgctgtagagccttgctagtgattctgttaaatatgataaatctgcatatctctaagaaacagcctctttatcaacatgtattaagaccacttttccaactgcctgcctggtcactatgtcacaaactgatacatgtataggacaatgatgtagtaaaatgtatagttatttagtttcaatttctgtttcaccagaaattatcacttagttgtaactgcatataaaataagtttagttaaacataacataccccaaatcccaacagtttgaagtttattagaggaaaaccaattttagagacaaggaccatagattttcccacaccagctgcagcattttactcccttctggcaaagcagttatttaggatggaaggagtcaaaaatgtcttctttagcccagatttcattgctttcacaagtgaaagtgaagatgtagactgacatttaatgaagccagatatttatgcaacaattttggacttctttgcacctggtttatccttagtttctgaggaagcatcttcaggagaagaaggatctggaaaaaaacttatggtaaaaataagaaattgttagaaactagaatatggccaactctggagaagataaaggagaaatggcctgtagaggatttgagaatggtgttgtacagctgaaatgccaaggttctttactagctgtcctggtccaatcattgctttgaaatatgaaattcaaaacatgctccagcagaggcaggagatgtagagaatgaatgaatcagatgaaacgaagtgaactcatcttggtttaacctgtgctttctttgggcccagcagttgcaatttctgagaatgtattttaaactgttattattaatcttctaatcttctgaaaaactttgttgagcaccaataaaatatgccacttttttcagaaaaaaatatttcagtggcttaaaataaataattttattttctcctaattctgttgaattctcttgaatagtagaatttctcctaattctgcttcagctgggatcagtggatattttttctgcgagtctcacatgaggtcacttatgtgactgcagcaacttggaggcttaatggatgaaataatctaagatgacctcgctcacatgtctggctgttggcaaaacccacacccctcaccaattgtcaagaaggctagctcatgcttctttagaaagtgttacttggtttccaaggggttgacaatagaagctacaaggcctctaaggcatagacctggaactctgataacataacacccatcacatcccattgatcacagggagttacaaggcagacccaaacataagtaggtaaagaaactgcctctgcctcttgatgaaaggaacattaatgtcacactgcaaagaagtgtgcacacagacatgagagcatttatgcctcttccccctgtttttggaatcagtattagtggttatgctaaaagttcttgccattcttttgcatcggtgtttacacaatataatactttgttaagatgcagagaatctaatttctattttactgcaggtaactcactcctacggttacatactatagagacaatgcttttctgattcaaatgaatggcaatattgatatttttaagatttttttcttttattacaagtcaatggagaaggctgacaattatatgtgtatatatacatgtatacatatatgtatatacatatatcatatatgcgtgtgtatgtgtgtgtgtgtgtgtgtgtgtgtgtatatattctctcagaaagaggttgagggcaaaattagtcctgtagtgtgcgtgtgttttggtttctgttaaatgatgatctataattgatttgtgtgccaactagaactgcctcagactgttttcagctattttgttctcaattcaatatgtagcattattcacaaagagcattaccgccctttcccagataatcaatcataaactaaagagaaaaagactgtttttaatgggatattgagaaaaagaggaagtgactaaatgacttgggtgagggggagtgatcttagtaagtatgaactgttttgtaataggtccagctttcttagcattccctttttatttaaccttatactgttagagatgtcagggcagaaatcaatgtagggggttagggacaagcattcaagcctcatgtatctaggcactttatagacagtatgttatttaaacttccgaacaattctattaaatggtatgtatttttacctattagattgtacctatttttcaaattagaaaacaggtttgagaaggttagtaatttatccaaattcatacagagagaaagtaacagaggtgggagaaggcaacacatgagcttaaatccaaatcaatattctttctcctattatacatagtcttttgatttagggatgttaacatcattatccctaatttttctgcatttctaaagggtcataagtaaacaggtacaataacctgcagttattaaataaacacaaagaatatagggcacattgtatctgataactgttctactagaaacatttatcaataagcattgcttaaagaagccacaaaaatatcttaccccccttttcaggatgattacaatttgggctggtttatttcactgttttagaggaaccactgggagaaatgtgggttggtaatgaacattaatgggctgtaactttgttatattaaatctttaatctggcctttaaaatattaatttagaagtcctaggttctatggtgaaggagcaaactaattcaataagaatcaaatccaatgtgtgtatttgtttttacattataacatctctgaaatcagaatttctcttacagccagtaataagaaagcatttgtcatattttaattgtttgagagtgtcctcaactcaaaatgacaagctaaggcaggcggcaccactcttttctctcttttatagatgtggtaactgaagcacgtaaatttaagtagcttgtccaatgccacacaggtagtaagcggtagaaccaagatttgaagcaaggaagtctgagtagcaagaaagtctgagataacaaaaataatctgactttggggtacaaaatgcaaaatctggagaaatttggagaatggaaaactcacaacgaatggcatgtcattgggaaaatttctgtaccctagtctttatcctaatctttatcttgcggctaattcattcagtgatgtcattggcccattgctttctcctctctgatactccttctgctcatcttcactctccactcctcatcattaagctgatattctctggtccaaagcctcagcctgtctctaatcaaatcctatactcccttttcctgtgatagttcctgtttctttcaataggaagctcaacaatgaatgaacccatctgtgggttcaaacatagatgaaacaaacacagagagaaatcatacaactgggtagattcttgatcacttccctcagctggaccctcaaaactttagcaaaatctgctctttttccctttaactgtctcccacttttttcacaccgactctttcaagtatccttcacctgcttcaagtcttccttctcattttttctccaattccaatttactctaaaatatctaactttatcttgaattataatctaactaaaatgttaaaatgtcattataataaccatgctgaaagatgttcattcatttttatggaacaaaagtaaaaattaaaggcaatgtaatagcctaattttagaagagccagacttagaactagtctcttgattaccaataatgatctccatttcccgttgtctcaaaaagtggttcatgcacatacacacacacatgcaaaaatacacacaagcacatatatatttgaccttatgttctcttcctgtgaattggtaattcattcatgtggtttgaaatcaaaatcacaacactttccctcttatccaccccatttcctcctacccactgtaggtggacagcattccagtgtttctttgtgcaaatatatatgaataaaaaacaagtattttatatttctacttttcatattaaaatcagcattatttgtatatatgtatttatttttcactaaaatatttttatcattttctgtttatttgctattttagtacagttgacccttgaacaacgtgggagttaagggtgctgacttctgcacagtcaaaaatccatgtataacttttgactccccaaaacttaactactaatagcccactactgactgaaagccttactgataacataaagttgattaacatgtattttatatgttatatttattatacactgtattcttacaataaaatatgctagagaaaagaaaatgtaattagaaatcataaggaagataagatatatttactattcattaagtagaagtggatcctcataaaagccatcatcttcatgttgagtaggctgaggagaaggaagaagagaaagggttggtcttgattgtcttggagagggcactggtggaaaaggtggagaaggtggaaggggaagcagaagaggcaggtgcacatgctgtaacttttattgaaaaaaaaatctgtgtataaagtcttcacagttaaaacctatattgttcaaggatcaaccacagttgcatagcatgctaatatatgtatgcactatagtttatgttcaactgttctctattgtaggcctcttgtctgtgtccaactttttgcttttatgaggagtgccacaatgaaacgctggtatacttgtcattttgttcatgtgaaagtatatctaagtcagttcctaaaagtgggttaaagaagaaagaaaattaataattttgatgcctattttcccataggtttgacaacagagtatatttatcacattttgctttttttgtcaatatgataggtgagaaatgatagctgagaaattttcatgtttaaaaactgcttgtatttttattactgagaattactcacatccttttctaattgcttattgtattggtggtctttttcttctccatatcttaaagcttgttatttatgtaggggtttagttttaagtttctgacatcaattaacaattttttccgctttgccctttttatgtgtgtacattttattttgatgtgttttgccttgtggacttctttaaaaaatgtaatgcaacttcttagtctttttccctcatagtttctggatttttgagttacaaatagaatctgctcttccaaggctatgaagaaatgtgtctattttttttctagtacttttatggtttcccttttacatttatgtctttggtccacttagtgtttactgataaggatcagaatttgtcttttgatgcttatccatttgttatagcaccattactaaaaactttgtccttgactcactgatttgagatactaccttatcatataataaattgacgtttctacttgaatctattttttatttggtttcattcacatgtctgcttattccagtgccaataatttactgttttagttgttagagctaggctgtctaatacataggttattgagcacttgaaatgtgactggtatgagatgagatgtgctgtaattgtaaactatacactggattttaaagatgtagtttaaataaagaattttaaatatattaataataacttattttgattacatgttgaaataacgttttgatatattggcttaaataaaatatattttaaattaattctaccttttaaaaaatttttatattgtagctactaaatgttttaaaattatataggtggctttcgttaatatttttattagatagcactgcttttgagtatgattaatacctagtagaattattcctacatcagtgttctttaaaaaaaaaaaagttttcctggtaatttactcttttttattttttccgtatacacttagaattagcttgtatatttctacaacaaatctattgatatttttattggaattgtgtataatgtgtaaattaacttatagtttatattttcattatgttgcaccttcctatccaacaacatgatatgtctttctatttcttcagtcacgcttaggtgtattttaggagtattttcaggttttgcttatataggtttggcacatttttcaaagtttatttcataatattttatctttctgtggctattgtaaatgtatattattttccatttatcttctcacttgctgtatctacgtatgattgatactaatttttatgaattaattattttccttgctatcttaattcattctcaattatcttgcttttgtagtgtttttctccattttattcttttgtgttttccaataacaaaattttctgcaaataggaagagttttcccaccccctttaagtgttatatctctaattattttctcttgtcagtacaaaatgaaatagcagtggtgagtgtgactatccttttcttgtttaaacttcagcaagaatgtctccattaggttgaatgccagtttgtgggctgatatttctctcgtctctctgacacatacacacaacgcacacacgcgcgcgcgtgcacacacacacatacacacatgcactgttaagaaagtattcatatatacttattttgatgaatgtttaaaaaaatctagaatggatgtttaatgttgtcatgtcttttctgatccaaggaatgactatataatttttttctgtcaattaggtgaattagattaatagatttgatggttttacttgtgatgtactataattttaaagtagttctttttttagttttaatttttttacagcagcatcaatttatactttgatttgcaaatgtaaattaagatacagtaaagagtaaaatacaaagaaatgaatgcatgctgtgcatagattattgatgagtattcgcaagccattctcaatcccaagctcccttgctgcttctacactgagtttggaggtaattgctcaccacacaccctcatttttagttacgagaggccaagtgactcaattatggcccatatgacaaacagcagacttccagggaaacttagaagaatatttgctttcctaacaagaagaggaatacctggcatagatttccttcctcttccgtcttcccccttcttcctattaaatgccaacagtgactggcattcaactcccatcttggcattcctgaagatgttcagctactacacctcttttcttcttgttatgttaaaccatttcttgattttgctttttaacatctcacttaggatatttgcactgatattcacaagtgagatttttctgtagatgcttttgaatttttttcatgttttagtatgaatgctttcattgctttttaatttttttaaaaaatttattgtccttactgttttctggaatagttaaaattgcattggaataagctattatttgacagtcgtttccatcctactaagattgagaaggaacttcccttacataaaggtttttaaaggctccaattcttttctggatctcaccctctcttaatgtctcatagactttgagccatggttatacatactgtctcctcatgattttcagtgtttctctttatgctggccctttccttcagaatgtaaacatatgcctacttatcaaatttaaaactaaacaaaactcctaccaaactcattgacccaaggaaaacaaaccatcgtaaagtgcagcacttcctctgattatttcaaaatctttcttttcttccctgatcagacttttgggagagttttcaacactgactgtccattttctcccttcattatcactcttcagcacactctactctgccttcccccttaggttactaataactgatgggtctgcgaatctaataagccccttcctgcaacattcactacctttcctcctttcctttggcatctgtggccactcctgattgttgtcccaccactctgatatccattcactcagagccaacttgtttttaagaaacttcaaacttaaaatatctgaaagtgagttaattacgtttctccacccgacaacacagaaaatactgttttgctggcaatattctttgcttcagtaaatcatgcttccattcaccaacttttccaaaccagtaatatgggagtcatccctagtatcactctgttccttatattcgctgtcaccaaggactgttgactctaaatctgaactccttcccaatccatctaattttctttaatccaaaccatccattccctatctctttcattattactgcaagtctctcacatgtcctctccaactctaattttgcttccccttcatctgttccttgcattgctgctggagtgatctttcaaaaacacaaacttgcaaatgactccctgcataaaagtactcagtgattttccatttccttcagaataaagtccagactccttagctgcattataagggcctgtgtggtctggcctcactcatatctaacagttctccttacaaattaccccccttagaaatgaaactatttccacatttcaaaagtggtgaggtatctctctcacttaaccaccatatgctgcttatgctggcctaccttttggaaatcgtccctttccctctccattttacctgataaatttttgatgatgtttcaatttaaagcgtagcggatcatctttgacaactaagctaacttctcttgttatgggtttctttagagtctagtatttccttgtcttaagactgatcacacttaattgtggttatatagtgtctgtcttttttgttggaatgaagactgtgaggagttgagaactatcagttccctgagcctaacatttagatactgaataacagctgattacatgaatgaatgaagaatatttgttagaagacagaatttttttagaattttaaattgcagagatcaagtgagaaggttccagttgtattagatctgagaaatgtgattaaagcagtgtttttgcaagattaatttgacatttttctgttgaaacagattagggacagattagatggaggtttgtagtgatgagaacatagacaagtggcttcatattagagtcacctggtgatattaaaaaaaatacctgtttcccaagctgccccagactgattaaattcactgattgcaagaaaacctaggatttgtacttttttaagtcaaacgctcacacccatccaggattttctgaagttaaaatggtaacagtataattggtatgggcaaaatatatttttcctaagaatgatagaatgtgaatgtgggcttttcaagtctagtggaccagagagccccattgcagtgttaaagaaatggcgaagtagaagaggggagttgttttaaagaaagagagagtgaccaggccaaaagtggctcagtactttgggaggctggggggacagatcacctgagcccaggagtttgagaccagcctgggcaacatggcaaaaccctgtctctaccaaaaattcaaaaaattagccaggcatggtggcatgcatctgtggtcacagctactcaggagtttgaggcgtgagaatctcttgagcccaggaggtggaggttgcagtgagtcaggatcatgcactccagactgggtgacagagggaaaccccatctcactatctccaaaaaaaaaaaaaaaaaaaaaaaggaggagtaagttttaggcatgtgggacacatatgtgtatatatacacatatatacacatacaatatatacacatatatgtgtgtatatatacacatacaatatatacacatatatgtgtgtatatatacacacatttacacatacaatatatacacatatatacatatataatatataatattatgtgtatatataatattatgtaaacatatatcacatattaaatatgtatataggtatatatgtatatatatgtttaaatacctgaccatcttctactaagttatgattcaaatgttccgttatctaggaggcttcctctcctctgcagggcccattgtcctagctacacctcaataactgctttcttttcttttttttttttgtcttttcctcaactcaattctaagctctctaaggacaagtatgttgccttactcatacttgtgaactcagtgctcaggacactggcatgcatagaataaacaccctctgaatgtttgcagaatgagtcagtgattagatatgagactggatgaattctcctgaagagtaaatgctaaggagaaaagagtgtcttgtaggaggcatttgcagacagacgaagctatagagagggacaatgcaagtaacctcaaatgagagtgtggaaaggcgggaaagcagccagagcttcattgttatgaaaaaagagtgaaatgtgctctgttgaagagttgaagaatgaacaaaggatatttagtttgaatggaagctcagtaatgagaaatgagaatggttgagttcttaaaagaagcaagtaaagaagaggatttgtgggctactaatctcattcagtgaatctcatacgacccttgcctagtgttaaatatgttaatgaattcatgtcatgctgctcagtcttactagccttcatcatccagagtaaaatgcatatgattcctatgaaaatttgtggaaaggaatatattaataggttagaagaattagaagaatgaaaagaaataatttttgctttttaaatggagaatcatgcatatttggagacacaagggaagaagcccatggagaaggagagatgaagctgtaaaagaaagatgctatgaatgtgctctcgacaggtgagaagatgcctcgacaggtgaggagagagtattgtgagcccaagtagaggagatggctttgagatgcagaaaaatatctctttctcaagaccccatttattttagacggttcgcggagcaatggtgctcaatcaatctttaccatagttattacataaaccctttatacatttcatcattaatattcttttctactatggtttgagatgcagaataaggaagataaacctatttgtcagtatttgaccataatcaaaatcaatttttatctggagtctttatgtttgttgcatgtgtatatgtgtttaaaaactaagttctgggaagatagcattacacttaattccgttggattacttttggatcatgtaagcatactgatttctaacttgtttaaatatttgaattatttgattctctaccagagattaataactctaaaaaaatttactggttggattaaaagtgcctgtagtttatccctatatttcatagagtacagagcgagatagcacatttgtctgacaaatttatatttatgtcagataatatcagttttgttatcaccatctgcattctgctatattttaacaacaatgtgaacagtatacatataaaattgtggatttacatgagatatcatcattaattttcaaataactaaacgttattttgttagtttaaaaactttagagtattaagttaaatagcaactgcagttctattttgtgttcttggaaatattacactttatagaggagtctattaagggaagaagaaaaccatgccaaattaaagatagtttaaatgataatataagtgataaaaaaactgttttgatatgaaaggaagttattacatggtatcgtggttatttactgaagatttatatagtgtttatatagtacatgacctactttttttaaagttgctaattgtcaggtatcccaagccaatatctactgcatattttctgtaacaatatatgcaatgaaattgtgtgttatgtttacattatgatttcaacgtttgttcttttcttcaaaaattacaggatatcatagagactgctagtcagcggaacatgttatcctaatataggtatatttatacaagatttaaaataaagatttttctattttcttaatatgtgtctagaagttaaataaacattataatcacagaagtcagataaaaagaaattcatagtcctctagacaaaaaatgtaaatcttttagtttattaatcatttgtaatcataatctagatgtacattttaatatcagaagaatttcccatgtaaccacatagtctctataatgttcattttaatggactcataataataaagttaatatttatttatttaaacactccttactgtaggacaattacgttgtttacagttttccaaatgtagataatattgaactacacttctttgcaactgtcattttttctttctcctagctttggattcaccagacctaggtttaatcttagcctctaccacttactagcagtgattttggaaaattatgtaactactaaattttagtgccctcaactataaaatgtgattactatttattactttgcaaggttttgtggaagttaaattctgcaaatattacattcttttcatgcatatttattgaacatatattctgtgacaggtgctattctggattctagggatattctactggagaaaacaaaagctgagctgtgagggcatgccacatttagaggttgggtcatagaaagaagtcagaaaaagagagaatcattagcctaaggagagaatcaagagagaaattgtcttctggaagcctagtgaaaacagtatatttgacaagcatggagtgatttagaataagagcaatgcaaaataaaactactgtctctcatgtattacactggacagcaacttgataatacctataaaaattgtaagtgaatttaccttataattcagtaatcccacttccaggaacttctactatatacataatgcatataaaaggcactaatatgaagttatgactgaatatcactattcattgaaacattttatatagcagcaaaaaattggatataacctgatgttcatctataggaagctgattattcaaactcaagtgcatccacatgatggaatattatgcagttttagaaaaggataaggaatctctttacagagctaatatgaaaaatctccatgttgtattattaagtaaaaaatacttatctataccttatctataataaagggaggggctaatgatacatatccatagttgtgtgtgtgtgtttgtgtatgtacactttaaaaatcattttgaggccaggcatgatggctcacacctgtaatcccagcactttgggagtctgaggtgggtggatcacaaggtcaggcgttcaagatcagccttgccaagatagtgaaaccccgtctctactaaaaatacaaaaaaaaaaaaaaaaaaaattagccaggtgtggtggtaggcgcctgtaatcccagctacttgggaggctgaggcagagaactgcttgaccccgggaggctgagatcgcaacactgcactccagcctgggtgacagagtgaaactctgtctaaaaaaaaaaaatagtaacaattattttgatatttgggtaactttttttttgataaagggtgcaagaaggagagtaagatcaactctttcaaatgctgctaataggttactaagatgagctctaaaattgcccattaggtttggcaaaggagatattttaaaaaatacaacatcttctagaagctgtgttgaaaggggaggagatacatggaatggtagctagaagatgatgtgaggccaatggaaaaaatattgttagggtatatagtgaggtgactaattcaccacacactgatgttaataattcactcacagattatagaggggaatattgatgatgcaaagacagtgagagaattacttgtgtgggtaaaaaacctaacaatgatgatgcatctggtcctcaattccttttggattcccattttcatacttcagagtaatgtcaagctacactcaacagaaatatttaaccaccttcttcattcccttacatgtgttcccttttaaactatttctctactgtgtggaagtactgatagattagaacagatagaccagatcagaattcttagagttctaaataagaccgtatatgtagctatctaatttaatattaaaaccatcctgtgaactttatgttatgatttccactttacagataaggaaacaggtcttcaggttatcttgtccatgctttaaaaatggctaatggcacatttcaaattcaaatgtcattcaccagatatttattgagcacctatcttgcattaggcatttatctaggtatggaaataaaaggatgaattagattgatatgacctctggcctcataatggctgtagtcttttgagggaaagagattcagtaaatcattatgattacaagagatgttacaacaggcaaatgctatgtacaagtagaaacaaaattctatactgagaaaataagctataatcaaatgtgctatgggccatcctgtggtttgaatgtgtcactcaaagttcatatattggaaacttaatctacaatcccacagtgttgggaggtgggacttaataaaaggacattaggtcatgaggtttctgccctcatcaatggattaatgtcattaactagggagtgggtttgttatcatgagcatgagcttgttttaaatatgaggtcacctccctcttgctctcttgcccttgtgacctctcttgcacttcctccttccaccatggaattatgcagcatgaagatcctcaccagatgtggcgccatgctctttgactttccagcttacagaactataagaaataaatttctattctttataaattactcaatctcatgtatagggacaaaaattgggactatgaaaggctataagtagaatagaataaagtatttacttgtgattcacataaattaatcagttaaaatgattataaataatatttataacaataatatttataattatataatctgtcaaggatcacagaataaaatatcttttaaatatataataggactaaaaatcccacaatattttgtgatactagttatgtaataaaacagtttaccttattcttcatttaaatcttaacattcttaaactcaatcatagttttagaaaacttgaaaataaaactcaaacatctaagttttttgttgcttttttgatgctcacctctcaagagtttcatgaagaaataataaatataatctttattttattttattttgagacagggtcttgttctattgccccatgctagagtgcagtggcgcaatcttggctcactgcaacctctaccgcccgggttaaggtgattctccagtctcagcctcccaaatagctgggactacaggcacttgccactgcacctggctaatttttgttttttgtaatagagacgaggttttgccatgttggctaggctggtcttgaactcctggcctcaagtgatccacccacctccgcctcccaaacttctgggattacagtcatgagccactgtgtttggccttatctttaatttttaaaaccatgttctttgattctctggaggaaacagtgttggaataaataataaatttgtaaacccagagtagcatataatcttgacttcattcacaataattgacattaaaaacagcaaagtacatctcatagtaccaaaatgcaagaggtgtggggagagacacaaactgaaggaaacacaataaaaaaagaaaagcacatgtcataagtcagttaaatttttgaacagattattatcacatacaaaaagttgtcaacaattttatatatctgattcaataccttgtctcagtgtcatgagaacgctaaggagtaacacagggttacctttttaaaagactttattcttttagcggtatgatgcatctatcttcttttgcatttaattcagaaaccggaagaattttctctgagttaaatttgaggtggatgccactgtgcagtttcactaaaatacccagacagtttgatatgatgtgcacaatctgttagctcaggaagaacaagagaaagatgtggttcttgtgtatgtatggaaagtcatcataacttccttcactcagtttctgtcttcttccagtcagggatctagtagcttgactattcttcattggttccctttcatttacaggtcacccaacaagacaaaccacacaggtaatctcttctgatccctgccatcgccaagagtcatttcctgccctcatcactttctaaattctatccaattcccagaatatccatgctccttctcactgtccctcattcacataatgcctaaaacactattcctgctctttgcctgatgagcccttactcacttgtcaagactcagatcaaattgtcaagactcagatcaaattgtcacctcttctgggagggcttcctcaacctctctaagtggagttaatcatctctgctcccacagtgtatttttttgttctctgttagtgattttcttatttaactgtctagctccatttctacattggtagtcctgggatggcagattttagtcatcttagtatcactacctggagcctggtctatacttgatgtttaagaaatataagtctgggtgcgggtgcagtgactcattcctgtaatcccagaactttgggaggtagaggcaggtggaccatctgaggtcaggagttcaagagcagcctggcgaacatggcgaaaccctatctctactaaaaatacaaaaaaaaattagccaggtgtgttggcgcacacttgcaatcccagctacctgggaggctgaggcatgagaatcacttgaacctaggaggtggaggctgcagttagccaagaccacaccactgcactccagtctgggtgacatagtgagactccgtctcaaaaaaaaaaaagaaagataagaaaagaaataaaagctgggtgtggtggctcatgcctgtagtcccaggtactcaggaggcagaggtggaggatccttatagcccaggagtttgagtctagcctgggccaaaagagtgagaccctatatataaaaaaaatgtgcttaataagtcattttggggaaagaatggtggagatgaacatcagagaatgcttagtggccctaaatttgagcatgaagacttcttgctactggtgagggggaaagagacagatcatgcacacgcactgaaaaaacaaagggcaacaagagttggacaaattttcaaagaactgcatttcatctatttcaagcgatcgtttctaaagggcactgcttcaagagtgtttcattggagtgtggttttaataaagtctagagccatttgcttgtcctcaagatgttccttgtaactctaaggctatatctaaattaaagctaatgaccaaacagagatatttttttctcttttaatgtctagcaggaaagagccgttagcaaatttatgaattagagtctgtttataagttgctgagaagaatcatcgtgtattcccttaagcaattccctctatcttaagaagtttaactgatatgctcaatgagcaagactcatgggatgtaatcaaaagcaactttattttttctcccatattctaatgaaatttattcagtggggagaagttcctcctctgaccctgggtaaaaactcacacaggctaaaattttgtttattcttgagtaataaaaagccctacagccattttaagtcgcaaacgtagtcttcactgaataattagaaatgtgtagggtcctatgtaataaccaaaacttgtaatttcattcgcagttggaggaattctttgtccttacagagggctggatgcacagcagtactttctcttgtctttcttccttccttctctctggcaagttgttctatttgatactgccagtgttgaaattccagaagggacggtggcgaagaggcccaggttttacttggctgacactgctgtgcagtggcattggaggtttaaatctgttctttccctcatgagctttttgccgtttcttcagagaccctcactggaagcctctctgaccccacttccctagaggagggtaatttggaactcatatggggcattttcctctgcctggctgttcccttatcagccccacatggatctaccccgttgggcttaccttgcccaccagatcgtcctctttatccagtttttccatagactccaggctggcccttgcttccctgggccacacttttgaatcccgatagccacactggtgtagcccatgtcaatctatttcactgcctgctacctcagattgacagcagagcatttttcctttagatttctcaggtgtatgccagacaccagtccactgtgccccccgaaatccaggtagcacatatcggggcatacatttggccctattgtctaagcttgagctgagaggaagatatctccttccctgtctactcacagcacactgaaggctgtctctaaagaatggctttccttacaaatcctcttttagttttcaaaatcttggccattttatatctttggtgggggtgagggttttcaagagtccaataaccacttttcacccattcatttttaaattctgggcgtgaaattcaccctttatggtatcttagtatctgacttggtgaaacttccactttaaattcctgctaccaaagtaaatatttacaaaatggttatattaagagacttgaatgtgttatctttcactgatagacattattgacttttacatatgaatttagcattaatgatctgtgtagagccccctaagtaacaaataaattaattgttttttatgcttataatatagatcttatcttgaaccactcacaggcctagtgagtgaagaagtgaacgtgtgaattttaattattcttcaaaaatcctccagatagtaagtggattggattctaacatatacatgtatgtgtttatttggaaccaggaaggcatttacttatagagtgctataaatagttgctttgtccgtattgtgctgcaataacagaataaatgagactgggtaacttacaaagaacagagatttatttcttattgttctggagtctgggaagtccaagtttgatggacttgcatctggtgagggctttcataaagcatcatcacgtggtggaaggcagaaaggcaagagatagggtgagagcaagagaggtgcaaactagcttttataacaagttccctcttgcaataactaacccactcctgtattaatctatttatgagaggagagccctcatcagctaatcacctcttattaggctccactttctggcactattgtattgggaatcaggttttattggcagacacagtcaaaccatagcagtagttcacaatagatttatagttgaattaaaccacaatcagatatctaggttagctctagaggaactccataatgtccctcaaagcactagcctatgatctgaatcccaagagcacaaaggggacatatggccttggtgggaaaagtgagggtttgtttttgttatttttttttcttttctgtgagatggtttcactcttgtttcccaggctggaatgcagtggcacaatcttggctcactgcaacctctgcctcccgggttcaagtgatccttctgcctcagcctcccgagtagctgggattacaggcacccaccaccatgcctggctaattttttgtatttttagtagagacagggttttatcatactggccaggctggcctcaaactcctggccttagttggtccacccacctcggcctcccaaagtgctggaattacaagcatgagccaccatgcccggctttgtttttttaatgagacagagtctccctctgctgcccagactggagtgcagtggggcaatctcagctcactgcagcctctgcctctggggttcaagtgatccttgtgcctcatctcccctagtagttgagattacagggtatgccaccatgcccggctaatttttgtattcttagtaaaaatgggatttcaccatgttggccaggctggtcttgaacgcttggcctcaagtggtctgccagcctccacttcctaaagtgctgaaattacagctgtgatcctggcagaagtgagggattttaaaatctctatcttatactgaattggataaaatgtttaaatagctattataggctagaggatacaaagtaggagacgtgggctgaacgagtctagagatctaatgatgaacatgaggactagagggtaatacaattgtattatatttgggattcatgctaaatgagtagattagattttagccattcttgcaacgaaaattaaaaaaatgtatagctatatgagatgatggatatatttgcttcatatagtaacctttttactatttttactgtagagcagacatttgttgaccctgtgttctaatatttctctctgtccaaagccaagctttctgttctgagtttcctacattcctaattcaccttcccttttcataaccgcaattcacatcaataccacggatctaagctgttgatagtagaaagtgttctgattgaattaattcacaccagtgtttaaatggctggaaaatagttcatcccggccagggatccaatattttcatccttaaaaagaaggtttattatttcaaattaatttcatgtgtaaaggtataagagcacctcacatagggcttggcatatgttaagctttcagtattatttgttgaatgaatgaatgaatgaatgttgggctttcaggcagtatgaagaatgaagtaaactttttttgtgatttagagaagatatttttaaatagaggtggcacttcctgaggtagatagctttagctttagagttagctccttagactattttaacttcaaagttgtaaagatgaaacccatagagtatttacaaatttttaaattttcacagctctatacctagaagtagaaaagataggcagtggaagattgggaagtttggggattaggatagggactatgatgacaaaagtcaagtttgtaaattgaggtgatctgaactgaaatacaatatggatagagtataaaaactgggttttgcctcaggtttccttagctttttggtccaatttatctggatccttctatgaagtccatataaaatgtgctccctgatttcttccacaattattttgcttctctaaaaaaactgtgccaaaggctgggcccaatagggaaagaaaaaaaaaaaaagaaaagaaaactgcattgtgtctaccagcagtgatgatcaatatctaaagaggaggctgatgaacttgtttgagctacatcctaaattgagtcagggctggtgctcttgaactgttttctccagcctaggcaatgggtaatttggtctgcaaaacaatgagaaaggcaatattgaattatgcatgctcataaagttcctgaaattaccatataattaatgctagataaaactaccctttactaccataaggagcaagtgggcacaggtaaactggggcattttccaaataaatactgatataaagcaccaggaggaaaaatggtttgacaaactcaatgtatgtttcacatagagtaaggctgtagggttaaaaataaaagacgggtgggggaagaaatgatcgatatgcaaataatctgaggctaattgaacttcctaagggagtcgagtttgggaacctgctggttgtttaagagcaatgaattctgaacctgtacaactgcacattgaagaagattattcatgtacttaaagaggtcatggtaccttttaatgcagctgcaggaatactgctataaacactgcacagatagtaatctttgagcctcagataggagccagagttagctttgcaatgctgcctgcagaaagaaagatctcatttgtgaaaataaccactatgttttcatattgccagacatctgctcttggctaagaacaacatgaaaggggatttgttttctggtagggttctgtctttctgcaaaagaagatcttcttttgaattaattgaccatctcaacagaatggcctacattcatatctacaaattaatctaattagggcctcctccttgggttaaaattgctatttaactcttgtggatgcctaatagcattcttgttcctttgctttacatcaaggtcagcaattacaaatgcagagtgcaaggtatcttgggatacaaaaatacatgatgtaagaaagtaggaagattaacattctgtggcacttctggtttgtgtatatccagcatgacactctcctgtctacacctttgaagatgaagtacctgagcacagagaggttaaataaattgcttaagattcctcagcatataaagtggaaaccaggtttcaaatctagagctgtccaaccctataacataggatcttcccccctgggttatactggttcccttaaggaatttcctggctgcaggaaaagcaagaattattaacaaaatataccttgaaataggaagcacctatgctggggagtaggggtgggacatttctagacatttcatcaaatggctactaacttgacagcatcttctgagtacacttagtgtttcaatgttttcttcccagtgacactgcagtttctttcaggtcaagatttttgaccttaatcttatttccccctatcgtgcctagcaaagtattggtaacaaagggaagagttctgttaacaagtgctgtctcactttgaaaggaacaaaggggtccaaatagaacccccactttgtcataaaggtgaactacttgcatatttcacagccatgcattttgatgttcaaaattcagaagcctatcatgtctttctgactacgaattgtagatatttaggcaaagtacacatttgtctaagaagccctctcctgatttaagtagcaaagggccagaaaactgttttcttcagaaggattttttatgatgtggtcaaaatgacatggttgcctaataaatagcaggtcatgctaatcggtcccttatgggttcactgtgatttcacagcagactccacacaccagcaacttgaatgatgttgacattctagctctgaacaaggtaaatacagttcaggctgggctatgaaataagtggaagtatctatttggggatgctaatcagatttggataccggcccttaagtattctcatgattgtgttttggttttagtttttaaaaaaaatctatgggattttattgaaagtgagaaaaatgaaatctcccaaataaacatgggaaggatattaagtggcctgtgtactgatagaaactgaaatgtactgcagaaaaaaaaaagagctatgcaaaatccgcattgtgtccagtttccttgctctttgatgaataccagactttgacatatctgaaatggcttggaattaagtcaaaatgtcaatggagttcccaaacatatttgtatattcgctaaagaaggagcattggacttcgagtcaggagatgagttctagtcctgagtcagtcatagtctgtgtgatggcacagaagtctcttagctttttgtctgtttcaatgacctcatgtggaaaatggggaaaataagtctttccttggccaacctgaagatattgtaaatatcaaagataattgatgtatactagtagtgagaagaattttgaaatgctacaaaatgtgtattattattattactatccagagataaaggtgttaaaatgaagatcaaatttgatgtatctaaaagagttaagcaataaaatactgtctcagccagatctaggcgatgtcttttgttgatgacaggaaaatatatgagcataaattggctttactaccaactgttccctactgtttcccaaggaacattccctttcaccccccaaacaacaattaagctgtagaaatctgttattgtgacatttaaccatcagacacttactttaccatttcactactttcttttttactgtccctggtggtaaattcactggagatggaagtactggtagcatgcaggttgggcctttggatttccagcagcaataattgcctaactgcttgaatgtcagtggttggtgttcaaaaggactccactaactgagatttacaagtagccccctttgatattccattaaaaatattgtagaggcaaagtgtgctctgagaaattgttaggaaaacgtgtgagtcaggtttctagagttctgccacatgcagctctaggttcaacaaggcagcgagtgcagggaaatgagcgtgagctccgatagtgaaaaccagtctccacatcttagctcctccatttgctagttgaactgatttgattttaagtaatttactgaattattcagggcctcactttccttatctgtaaataaagcacaatgatgcactcatttatttaactgcgtgtgttgaacacttgccacgtgacagataagtgctagatttggaggagccagtgaagatcaagacatacccatgaagggtttacatatagtggggaaaccagagaataaacagatcaaccagttcaaaaataagatcataagcccctcattacaaagtttagtgagcaatcaatgaggaaggggtatagactatgagaagtgtgatgtaattatgggatgaaaataataaaaatggggacaagcaagaaatcgagctgaaggaatatacgtagaggactatatctgataacaactatagctatcagtgcattcagtaataaaatagctatcattgttgagcaattattatgtgtttcatgccataaagttatttatacatctcatattgttcactttatataccaatgaggtcattagtattgtctcctttcacagagcaggaaatttaagcacagtgaggtgaagttattttcttaggtcacacagattgtgagtgatggagttggaacctgatcccaggtgttttaatactaaacattcatgcacttagccactatgctataccaccataacaaaacctatatctaaattttatggaaatattaactaagtatctgcttctctgtctacctaccacaaccaccaattataaagaagcctctacaattcaggagtgtgacccatgaaaacatttcatattgtaatttaaatgtctgcttctcttgtggggtttccaacttccacagtagaaagttcccactaatatatttccttgacaaataaaataaagcaagtgtgttgttctacctggaaatctttaaattatctctttaggctttcagcatacaatttacaagtgacaggcagcatatttcattatctttatgtttgaaataactttcaaagagagtggagaggggcgtttgacattattgtaatcaattctgtcagaaatattattggatttacttgattttgtgaacacaatcttttttattgttattctgaattttctcagatgttttacaggaggctaacataaatagtaaaatatgcttcaccaagacatctgttgaaaaaataatgaggaggtgttcttctgagcagaggcactgtgtaagctgtgatggcctctttttatagcaaaaaggcatatcctcagtgtccttgggatagcgcaaactccattctcctccatcaggaaaggcagtacagttttccacagcctgaatgtcagctggatgttgtgaggttcagcaggaaggaatagcatagagaggcgctaaaaaggtttaacttgcacagctgggagaagtcccaagccctgacgaatttatgaattagtctatgttggcacctatccaagaagacttgcccaaatctggtgctttattggctgaaaatctttgtgcaagcttcactcttttgcctggttaccatttaaatattgggtccttctcactgggacttaaggttgaggaaggcacagggcagacatccctgttgttggtaactctatatgactcatgtccaacaatcttttggaatattatgaggaaaagtctacctgtgtctccgtttacgtagttaaggggaatctgattgcattcctgggcacaatttaagactggagtagaactatgcattttaagtaaaaaatctaaaagcttaaaattattaccatgtgttctagtttactcttaactgctttgtaactgttgttatctaagtttcctaaacaagtgattcattgattttatatgtagactctgagagagtatttggcagaggcctttgacataaatcaaggaaggcattgttatcctcattttctatataagggatttgaatatctgagaacctaataaaattatctaatgactcttggctgttaaatggcaaagcagagggtgcttagaatctagatacttttcctgtgataccaaaatcttgcatttggaaatacttttgccatgtatttatagtagagatgagaaccttgattttgctttttctaactgttctactcccatgaattagtttttaaatcctttggcttgtagtactatgtgtgacttgtatgtatgtctgatgtgagtatgtatttatataaaatgagaaatattctcaaaagcctagaggagatatctttaaagaaaattttcttcaatcaacatttaaaaatggtgagttatttatttttattcctcaaataacattgggttatttttggttatttaaataatattttgacattttccagcatgtttttttgaggggaggggagtagggcagtgaagaataaggcagtgtctttcccatttttgtattccaagagcctagcaaagtagcacgtagttcagactcaataaaggattactgaatgtttaaaattttcaattagaattctgcagaaaagcagtttgattcctttcaaacatatgtacctactcaaatttagctaacataagctaaaattacctgggaaagtatctgaaatgacctattttggtgaataactgagtataccttccagttagcatatcagatatcagtatgtaaatgagtacttacaaaccatttgaaaatctataatttgtgccctaaagagtcataagtacagtattgtatgcagtttcttgttagaaattctgtgagttatgcagtcagatcctgcccccaaggggttagtaggcttattggggaaggaaggacttaaggtagttgaactgcctggggaacaatgctagtaataaggaatagtatcaagggccaaataaggctttaggcaatacaggtttaaaacaaaagtaacttaagaaggcaggacaagaataatgggaaggtggaagagggaagtcttcctacagaaagtggaatttgagctagagttataaagatttgcatcagcaaaggcaggggaggttagacctagactgccaaagagctggaaggaagagacgaatgggcacgggaatgacgccatcaatgtggatagcaaggcacagtcgggggactaatacgaatgaaacatggtttgtccatcaaaggtaattctgcctttgttttgctgcctgatatttcacagatttgtatccaaattgatgaagttacactgtatgtcctgttgtaaatttctgtctctgtttatcaggcaactttctctcagaagctcacttggaaatcaagggaaataatacaccgtgcagaggaaagagaatctggtcccttgtgcctccctgctgtggtgcagcatggtctgatgaccaagggcacaggatcctatttctaggattagtcagaaagaattgagcacatgtctgtagacttttgcctcagtattatattttagatggtttagtcggagctgttacatttggcagcattccttgttagcatttgataaacaattattgccaaatgttagcaaggaaacctgccaaatgttacagctcagatttaactgctgaaaaaaatgcagtttgaaaaagccttttgctacagagctgttgcctggtgtgccagttctgaagctgcaggggaccccggttgggaaaaattgtgactctaaaggtatagggccttttgccagcagttctgggttcctctctgaagttatgaattaattgacacctgttggttttcaaagcaataagtttggggccaattatttatggtgaacattttgttgcatggcttctagtcacattttatatttgacacattctctttcatagcacttttcaccaataggtaaactgaaagatcatcaatcatacagtctcatcttgcttatcttttggtggattacccaatttctttcagagtctaatgttctttaatagctcctctgggactgttcttatttcccacttcacccaggagacatttctccatcttttcattcttattttccatctttggtttaccaattaaaaaaaataccaagataaaatgaccccctccccgtttttgatagttttaccaccctggtaattcaagagaatactgtggacatagtgcatttagattatagttggctaccatgtcagaagaattctggttatgtgattaggaacaacataaaaaatggaaagcacagttaagcatctttatagcccattgaacaggtctctcagtgggagctgattagcttcaaatttgaaggtctttatcttggtgtttcacagacctttgctctggtccctgccctacacaatttcaccagaggcttgtgttaggataggcatttttattgaatctgtaactggtttaaatcttgggggataactaaaatgttgggagatatttaaggtgaagaaagataaagaggttaaaacagggtaaaatactggaaaatctgctgaataggaattgattgaaaaaattacctttatgttcaaaaagccctggcatgggtataattcacatttgtattttctccctgagatctaatccctctcccaaaatggtgagctcgttttcttccaaacagaagctcataataccaaataacttgctttcctggggcaatgttcctaagcagctcgaaaatagatatatgaccttgccttggccaatcagatgtgctagtataagactttaaatctgaagttagtgactcaggaatgaaagagaatgaagtattaatcttgcagggggtatggtggtatctcaaacaattagcatcagtggttttagtaggagccattcactttcggtggcagtgacagcatgtacttcttataatgtgtaataatattaatcactatactgactttatctcctaattatttattgaacttttctaacctccctatcactactactgttttcttgttcatatctttatgatttcttcccaaagcaatataaatgtcccttacctgtattgttatatctccaagtctattctcttcataatgggtaacatattaagatatctatataaaaatgaaaaaaaaatgctagagtatttctcaacccagaggaaagagaagatatagtagggagatgttagttaatgattcaagattcataatgacatgggacatgggagggaattaagagcatatttaaagggaatagcctagtcaaaaatgcaaagaggaagaatgaagatgaatacaaataattttaaaagttggggtaagaaaatgaggggtactagatgctttcacacttgtctgtgaggtagaaggcaagataatctggtaagatttgaaatcatcttggggagatagaagttttggaatatccactgagggaactatgagctggctaaggaaaatgaagtaattaccatgatgaggactcagccaagattgacaactacagaaagtgttgcagcattagctgatatgcttgtgaaaagaaactctggacaaaaattgaagggggataaaggaacttactttgtggtggaaaaagtaactatggacaggcaccaacatatggatttttattccctcaaagttagaataattatggaaaatggcaagatagaaaggagttgattattaaaatacaatgaaggtaaaaatcactggagtaatatttgatctaaaatcctgattgcaaatctgtattcttttctgagacctaaacatattttccttaaaagagagaggagtggtagtttcactggctgctgctgctattgacccagcatcttaagagacagtgttatacgaacaatggagcttcctacctaagacacaaatatgtcagcaacaaaactaatagaaagaatagtagaagcctaaataaataatatatatcttaaagttcatattacctaaattcctacccagttaattcaatttgtaagtttctagaccagcttgaataatactgcaagtaacaacttacctcctttacaagacattccattccattatagagctgttccaattattagtaatttctttttgaattgtgtaaacacataggcaaaaagttcgtataacttaacttttgaaagacatatcttcaattgcctggcaacctttgtgttctctacacttcattttacaataaaacaaacccattttctttatttgacccaaaaaggtatggtttttaggtgttttaaaatttagattgtgaaggccagtgcttgacttacaaactggcccttctggattagacaccacttttcttttccattcttatcttggggtgtccttgtctcttctaccctacattctagtccatctgtcatttcagtctcctctgaatgccattgattttgcctagaatgtccaccttttcattattttcttggtgaactcttatttatcactcaatattcatgtcaaatattactattcctgtgcctcaaagcagctttggctacacctcctctgcactaccagtacttcttttatattaatacggcacttcactttatctttcccagtagaataaacttcaaaaggacaggaatcttactaatcttttaattttcactgcttagtatgatttgtcatgtagaatccaataaacattgtttaaatacatgtttgcttgtctaaatgtgataccccaaactggacaaaatactttactgcagagtaaagtaggagcatcacattattagatctgaattctgtatgtctacaaaggtgcttgttttgttactttgttgtttgcttctttgtttccgaggtggctccagtttactcatgttgtccttatatacaactgcatttcctgttgtttttcaccagaattgcagctcagccaaatctccattctaagttcctaacaatagaaactgactctggataaatttcgtcccaaaataaaagtggttgttgaaatgtgttgtataggtcacaaatgcaactggaactctggaatttagaaaacaggcaggagaaggtggaggctaagcagctagaagcaccaacaaaactctggggaacgtggacatctaagtggcagatggaagaaaagagcacaggaaggaaaactgagaaggagccatcagagaggcattaaggagaaccacagacatgaagagactagagaagagatttccaagtggatgtggaacagtggcaaatgcagcagagatttaataagatagtggttgtaaaatgtccattccatttggcaattagtcattggtgagcttggcaagagcactttcagtaaagtgggaggatggaaggtggcttccagtgaggagttaagagaataggcagggtagactaaatatttgagtattcccagtgagagttggtgaggaaaggagtatatgacactaagggagagcttttattagttgagtcttgtgcatttctatcagctgtaggaaactgctgggaaagagactggagtaaggaagagggaatagatggttggtttaaatgtgtttctgagaagacaggagggatgggggtagaagtcagaaatgtagtcatgacagtggaggggacacctcattctctgcggtgggaggaaaggggagaagtctgtgtgaacttaacaatgagtttgccattctaactggtgtgagatggtatctcattgtggttttgatttgcatttctctgatggccagtgatgatgagcattttttcatgtgttttttggctgcataaatgtcttcttttgagaagtgtctgttcatgtcctttgcccactttttgatgtggttgtttgtttttttcttgtaaatttgttggagttcattgtagattctggatattagccctttgtcagatgagtaggttgtgaaaattttctcccattttgtaggttgcctgttcactctgatggtagtttcttttgctgtgcagaagttctttagtttaattagatcccactttcaattttgtcttttgttgccattgcttttggtgttttagacatgaagtccttgcccatgcctatgtcctgaatggtaatgcctaggttttcttctatggtttttatggttttcggtctaagtttaagtctttaatccatcttgaattgatttttgtataaggtgtaaggaagggatccagtttcagctttctacatatggctagccagttttcccagcaccatttattaaatagggaatcctttccctattgcttgtttttctcaggtttgtcaaagatcagatagctgtagatatgcggcgttatttcatgagataccatctcacaccaattagaatggcaatcattaaaaagtcaggaaacaacaggtgctggagaggatgaggagaaataggaacacttttacactgttggtgggactgtaaactagttcaaccattgtggaagtcagtgtggcaattcctcagtgatctagaactggaaataccatttgatccagccatcccattactgggtatatacccaaaggaccataaatcatgctgctataaagacacatgcacacgtatgtatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaactggaaaccatcattctcagtaaactattgcaagaacaaaaaaccaaacaccacatattctcactcataggtgggaattgaacaatgagatcacatggacacaggaaggggaatatcacactctggggactgttgtggggtggggggaggggagagggatagcattgggagatatacctaatgctagatgatgagatagtgggtgcagcgcaccagcatggcacatgtatacatatgtaactaacctgaacaatgtgcacatgtaccctaaaacttaaagtataataataaaaaaaaataaataaaaaaaagaaaaagaaaacaatgagtttgattgtgtggggatgaaaagttgatggaaatggcctttgattgttgggattttctcaatgatgtagaaataaaggtaatctactgagactggagtaggactcttgaggagttccttttttcataatttttatatgtggtggtgttgaattttcttccattatccaccccttaaattgtgatatttgccaaagtttacactcaccctatacagattaacctaggggtatgtggagttgccttcatcccagtgtgtaatgtatcctgttgtgactatataggcttcacctctttcaattgacagcaaatttagagaaaatacttatgtcttacttccatcctttgtctataaatgatctttgatcagtgtttgctgaatgaagaaaggatttttttttaatttaatctctttactctggtttaccttgaagggttatataattgacatatttagagtgcaaggcaaagtagaggtggaaaaatggagtgcacttttgtaatacctcactcttgaatttttacatgaatttaatgtatgtcccttcatttctcagtatttcatcagtaggcctctatgctctggtgtggacatcttatattgcatatgctgatgtgttcatgcaatatcatgcacacttgaaagttgaacaaatctactatgaagaagactaagggcttaattcttcttcccctgaatccataactgggcctatgtgaagctgcttggagagggaggcaagagacacaacaccccaacccctcctagactggcaggggcagacacacttctgtaaatggccagtctattcttgtgactcaccaaagcagcagagggcaggatgctgctctgacatttgcttagccatgggtgatgaccacaccctccctgctttaccatttctacttttatttatgagagaaatgttgtggttggcaggcctttgtgggctgcccagtgtgattaagcagttctgggttagaagaggacataattcttgggtacagaggcctggagaggaaagatgtttgcttggctctgaggctgtgtcaagcaattagcacaccttgtggggctggaaaggggctgtaggacaggatgttttctgtatcttcagaatacttattttaggtcctcaccaaaaggaactttacatctacttggaaaggagtggaagaatactgggagtagcagctgactctcttcattgactctggtgcatggattttatatttccttacatggtttgtcttccaccttaatttggaagaccgtaggaccacatctataaaggcagtgttactattcagcagttatgcttgaaaagagcgacgtgaaggccggcacctgttctaatttataggtgcctgtacagtccctggatgttccgtattaaaactaccagacttggataaaaagaatctctaggcagagggatgcttcagtttacactcgtaaaaatatctaatggttatcatttaaagggtaatctattatgtgccaggcactgttcgacacattttatacacacttgattttggcaatatctttgagagataggtgttattatccatatttagcagatacatactgagcctcagaatgattcagtgatgtgattaaagtcacaatattcgtaaataaatagagaagcaattcaaatcaggtttgtttaattctaaagtccactccttttccacttactgagccctgcaaacagcctcggagaggaaaagtagcattgaataggcaatagaaatcctgaaggttgggtgggtggatgaaaatgggtcattttctttgcaaaactctcctccctcttcttctcaacctttgcattaaggaatattggggcagggcagagaaaaaaaggggatcataggctgatatccatttgaatttctcagggcctcattgatcaaactggaaagggtgctctgtctcattttctccccacttattctcctgtttaacttgctggaactttaacattttgaccaagaatattctcaaatctctgtgtctttggaactgtcctacaaaaagtttaaagtcatgcagcactagtgtagatatgagaggcaatgaaaaagactgaagggggaaacaaaacaaaaggcttttcacctcaggcaatttttttttcttatggaattgtccattagctgccaagtatctcctgaatgtaacagctatgttcttcttgaatatatgcagagatgattgggaagcttaatttttttaagctgagagttgcttataaaagtgctgatacaggcagggtgcagtggctcgtgcctgtaatcccagctctttgggagaccaaggcgggtggatcatctgaggtcaggagttcgtgaccagcctgtccaacatggtgaaaccccgtctccactaaaaaaaaaaaaaaaaaaaaaaaaaaaaaattagcagggcatggtggcgggtgcctatagtcccagctactcgggaggctgagtctggaaaatcacttgaacccaggaggcagaagttgcagtgagccgagatcgcaccattgcagtccagcctgggtgacaagagtaaaactctgtctccaaaaaaaaaaaataaataaataaattaaaaaatttaaaaaattaaaaaaattaaaaagtgctgatatagtgaagggtctgaggttttattttacttaatattaatacatgtactaggagttacagccccaggttgatgaggattaggacatctggttttcattccagaatcacacacactgttgctgtcattcctgtcactgccgttagttaaaagggtagacatatgactaaggcactggggcaatagaaccatggttaggagctggactgcctgggaacaattttcacatgttcctcacactagttatggggccttgggcaagttactggaattcactgtatcttggtttcttcatctgcaaagatactattttaaataggctaatatatacattgcacgtataaagtatccctatataaagcttattattttttattacacaaaatgggatgacactctctagaaatgtaacttagttaaccaaatgaaagctcagactttctcctgtccctcacaggagagttctagaaggagaatttcctgatgaggaggagttctgtggtccatggatctaactcttcactgtgacatttaccttccttttggagttccccctgattgactgtcagctgcatctcactggcatcaggagacactgcttttttgataatattctaaaacccaggcatggggacgagtgagggtgctattaactcaagctgaaatgggggtgctactacaactacaattagattttaccagtagctcctggccagaagagatacataggtagtatgctaccaatttctactagacacctgtggctactactgaacacttgaaatatggctagtctgaataaagacgtgctatcaaagacataaaattgtaacatatcccattcactgtttggttgaatttcaaagacagaaatgtaacaaatcctattaattgttataatgattacatttagaaaggacagtattttttatttatttggttaaataaaatatattattgaaattaatttttatcttttttaatgcggatgctagcaaatttaaaattacacttgtggctcacatttatgactcacattacatttctgttggacagcactgatacagatatatagcttgctcttcttgtttgctggcctctttgtttttctgtgatttctttgtttcttttcttccaagcttgttgtctcccaccatgtgatggccaacagaaaacccattacccacatttctatttcttgactgccttgaggtcaagactaggagagtgtcagagttaactctttatcctgcaggaaatgtgcaccaaaaccaaacttagcacttagattaagatctgttcattgtgcacagaattgtattcttactcatgccatcctcactggaaccaccacatttcaatataacaaaagtaactctgatatttgtagaataaaaaatgatcataaaagttactcctgtgttagtcatctttccatttatataattataaatgtatttcctgctttaagcacgccaggcatatacagtttactttatttagcttatactatgtgatattaatgaaaatattctgaagtagataatatttacatatgaagaaactgagatttggaaatattaaataatattctgaaggccatataactagtgtgtttgttaaagttggtttaaattgaggtttatctgtctgaaagtccatctttgaacccattatatgtctaggtgaagtatcgtgtttctccacttaatctccctcaaccagaactctcagcacagttcttgggcccaaccaccaggattttgctgctctaccccaagtcttctgaattttccatgtcagagtgcccatcctttcccttcagaaccctgtagaaagatgttatgagagactgtttgtttccagttttgtaagggaaagggatggcttcttcaaagaaccaagaattgggggaacttggaacatggtaaaacataatgtagtgatgtgattttttgttctatttaggtatgaaggtgaagcttaccaaatagggatgtgaaattgttcagcagccttctcctagtataactcctcactctggaaaagtggaggaaacaccattccctgtaccgtttatgtggttgtgtgcagtgatttcaaagccagctcaacttagaactcttatgcttacttagactcacatgtttacaggcattcagatcctagtctaggtctccgaccactgcaagctgtagattcctctctggcagatgacattaataatagtgcctacttataaggttgtaggagtaaatcagatgatgtatataaagcacttaactagtgtgggaacatagtatatattcaataaatgttagcttttctttccatgatttcccaggcattaacttacgggctctgagcactctagaagaacaattgctgttctcaatccttgctaatgtgtcctatggtttatatttcaacccagtaaggttgtctcggattttgatgggaaaagtgttaaagtgtgcatggtccccagaagagagtgaagacgccctgtgcaatgcccgtctgcatcagcattacagcgagcagacagagacatagcacactcctgggtgtgctctctgtgcatcacagaaaattgtaagctccagtagctatttagattgctaacttggggaaagaattcctcttcttgcatgtgggcaggatacatttgtttccttctctttctgccattcctgattctttgatggacagaaatggaaagagatttgaggctccaaagggattgtgtggtagttctctttataaggcaatgattgattatttctttgcacaatttcactttaattgtgttcatttactacacctgactaacataaatgcatattgtggtatataatatatccccaatgtatataaaataagagctattattcctttctgtgttctggtgctaataaacaagctattcaagctttgcttaggtagtttgcagcattactagaatgccttgatggaattaccaccttatccatatacagttgggagcatatgattccttttatgtaatgtaataccctataacataatgagtatcattaataaagtgacaaaataaaacttgaactaccacttcaggatgtgctttattcaaccagtaatacactttttggtcctttgtagtttctctcttttgaattcatggcttactgcattcaaactgtgatattaacacaccaaccaagcgtaccctgttgtgtcataaagccatggtactgaggtgtcaaaggagaaaaaaacaaccattattctaaaacagaaactggggaatgttactgtgatgctttaaaagaagatatggctctcatgaataagcaaatttatttactacccaaaagcaacatttctatttttatttttggaaaggtaagtgttctttactcagaaagaaatgttatatgaattctgtattttgaaaatggaactaaaagataaagtcataaattagtttttgccaagtttagacatcaaggggtggcacagaatgcggtgagaatactgaacagtatggtaggcagaaaaaaaaaacctttgattctcttttttttttttttgattccacttgatactactagttgattagttcagagtaattcttgtaaagacagtatctgaggttttctctggatagctcattcatcctcaaagcatagaggatttagacatttgatggtggtgtcaaggatatcagttagaaagggtggttttacttcagatagagtaagctcagcacagatttccacaaaatatagtgacatattcagatgatgctcaaaattttagaaattggtttctaattctaggtggcgggaagcctgtatgttcacgtgagataggcaatgagaagatttgaggtttcttgatattcagcagcaggaagaattacacaagtaggagtataataattataaaattaagaagaggtttccctacagaaggatcagaaataggtcataaatatgcaaagttacaggagaaaacatgtcatccctagtccagaatcgtatttccctgaactttctggttgatacattgaatgcaactatgtggcctcagtcttccttactacctttggcatcctttcaggaccagtgcaggacagtttgcaagagctatataattaagcatggttcagtgcaaaaatataaataacataattgaaagatgtgaagaattaaatgagttatcacaattcagtcaagaaaccaggactaacagtaggtcaataattagtgatagcttcttcttcccagattttctggcattaattttgaataattagatttttatccatgatgttgttagacttaagcatggattttcgagaaacatgcaatatgatattggaaacaatttataaatcactattcatctttggaattctgatgttcattgagaaaaagatctagtgtaaatttggtggcgtcaatatcaatcatagaacttggattcctgaaatataaatctacaagtgtttaaatccacacagtgatattatttcaacacctgcaggccaaagtaatgagcaaacttctagataaaacaaaagaggattttgaaaagaactgttactatgaaattgataactagaagttgatctgtagaatggctgagttttgcccacttcacttagtcaacagtattctctcacctacatttctttgtgattacatatctttaaattgtgtaactgcgattgtcatgcagctctggaatatgtcttttccctgaattacatcaactggcccaaatgagaaatcaaacctacatatttgttctcactagcaccatatgccaactatctgaaaataaatcttgtgtttactgctatgtaattcacatgctagcaggtctgggaggtcccagcagtaaattatttttaaaaattgttacactagtgtacactgaatatttactcagtatttcagttttttaaaaatgtgcatataatcaattgtagatcctacagttgaccacaatcccattaatttcataatacataacaaatcatgtgtgagtgaatgcacacaatacaaatctctcttacattgagttcaagtttcaagcctgatactttaccaaattgatggccagtacactgagcttcatttgtgctcagttttctcatctgcaaaatggtatcaaagctctcccagtagtatactggttggatatcatcatcgagtagaaaaattaacaatgttgatacaaggcacagagttcgacataagctatatcaatcactataattatcccaataaaacgtagaaggaagaagattatgtattccttttagaaaacatgattttttttcttcatctctaacctaccactcatctctggttttaaaaatattataggttatacggtggctcatgcctgtaatcccagcactttgggaggctgaggtgggctgatcacgatgtcaggagttcgagaccagcctgaccaacatggtgaaaccctgtctctactaaaaatacaaaatttagctgaggatggtggcacgcacctgtagtcccagctactcgggaggctgaggcaggagaattgtttgaagctgggaggcggaggttgcagtgagctgagattgtgccactgcactccagcctgggtgatgaagggagactgcatctcaaaaaaatttatagtttatacaaaaattaatcaattgccatgtgtgaaatatgaaagtgcaaaggtgacactaagttgccacagtttatttctgtgtcatttggcaaaactgaatgaaaaggcttacattcactcaaatcgagctattcctgacaactgtcagggaattcaggttgagccaaaagttccagatacattagaaaatctctctatgtttacaaaaaagaaggttccttttggatgaagaacaataatcagttcaagcctttcttgtacaggaagaggtaagctacaaagtgagctataatcaaagctggtcctcaaaattggtttatcctctcagagggcttcaggaattctcagactgatgtggaaatggagagtgctcttggagacattgccagtctgtaatgaactctccagatttatcctgggcccagcttcttccagtgtaggatagactgtgtaaatctgaagatactagaactagactgggacaaaggatgaggataggctccctcatttaatgttaacaccaaagcctgcagagagccctcagccttttaaaaaatattgtggtagattggctgccaactcttcaaaaagttaattaataaaatgcaaataaattataaatgaagagaatcacttggttaaataaattttattagttggaagaaatgcacacccaatgttattaggctaaaatagtatattaagtcaaccaaaggaagcctttgttgtaacaatattcatacagtatagagttttcagacagtaatttttttgtttacaaagcttatatgcagtgattttatattttccaggcacagccagacctgcagagataagggacatattgaatgaaacaacaatcctattgtgattgaagttgtatgtttcgaaggccattcatatcctatatttgttaattaaatatgtaggcattctttttaaaatagaaaaaaagaatagctgctggcctatctttagttgctggattttgcaaaagatttatggatgttgcctgagaatgttgaaatctcttatttctgacaaggttcaagttctgtcatgaatgtaatctgcactgccaccaaaaccagctggcaagtgaagtggtttctcatgcgctcctgaatccatggtgtaggtttttctaaatatgatctgtattaggcagtttaaataaatgaatttgaatatttttaaccttgtaattaaattaagtgttctatactgtgtgttctgaaatgcttctttgcaaagacattgcagagtgaatttaaacataagaaactatttaatcatttcaattaagagttccctttatctgtgaagagcaaaatgtctcaaataaaaatattattttttggtgctgctggtacacttttccagaaatgcagctgatctcaggttttttcctttaggctatcataaaaaatattatgaaaatggaaataagatataaatgttcagatgattaaaaatcttgcattcagagtgtctttaaagttaacatacatttgacagttggtcttgtctcttctggggccactaacacaccatctacagcaatcctaatagactacaaactgctaaatatttgttaagtcaggagaaccatattttggtggggctgggaagttcagcagtggcaacagctactgggcaactgtccaaggttctgaaccatctgccagctttgacatgtttttctctctcctgaacctgagaacctggtgacacccgtctagctactcccagattgtatcttatttttattatatttatcagtaatatataatttaatttttttatttatccagaataaacagagctggaatttatgttacccaattgaagtgttaattttattttctttaaaaaattaactatgcttggcgtatttgcatatattttccattactggaagtgggaaggtagaaaaagttacatactcctctagtactatacttctgacaataaagtctttgaaatataaagaaaaatccagtgccaattctgacaactttaacggccatgcagtgtttacagctatagactcctaatgatctgcttcctacacaatgtctttgagatgtgcttatgcaaatagccaaaaggatattttttcctgccgttttctacaaatacaaacctaattttagctgagcagcacttagtatacatgggtggtgatgtcattaatgattttttggtgtttcttgctccaaatatcacaatttgaaagatatattaatccagccaaaagaataactctaataatgctgagagtcccaaaatatgatccctcttggcttacccatctacaagggagactaaagagcatgctattaatcctgtgttaaaggaatctggcagaattcgaatgcctttataatctataatgaagtattatcaccctagtaatgttgtatgacctttaggggcctcagcttttccatctttaagtgtgaagtttggatttggtgatgttaatgataacttcagattctaagcttccatactcagtaatcttggcaggtgtgttacctcataaaccattcaatgttctaagaaagataccattctttgtactacactggagttccagtgagtattatgtatataaacgtataagtaataactgcattttgcttttctgtttggtgagccatacagtaaagcagcacttcatttgttcataagacaagatgtcaaagtctcaataaacctgtccatgtgtgtgaatgtgtgtttgcatgtgtgtgtgtaacatagagacaaagatagagaccctgacagagactgttcagtgacactggagaggaatcaattggtttaggggaaaataagcaaaaaatgacacagaaggaagcatttgctgaatataaagaactatttctatggggtttcataatgtgccagattcaggcctattctttcccaagtctgaagattccacactaaaccttctccctaagcattataagagtaagagacatttcactttgcctgtagaatgaataaagtcccaatgatattttagagctgtagttttgagatatttagatattttatatatttaaggcatactttttatctttatgcttgtacttatagctttatggttatattaatatcaagaattgcaggcatttacaatccttttaaaagttacagaattctttatggaacttgaaagaaactatctatatttttgttagaaaatataatcttagataagaaaccaagtcaattttttgctttgtaaatctgttgtcatagtaatataaatgtacttgcaacataaggacagacccagaaaattaaagaataggaaaaaaagttacatttggtaatgagaggttagatttcgtgaaaaagccagtaaaatccaaagaacactgtaaatttttggctgcagagtcagccactgttggccagggtctacaggatcagtttcacactgggcatttgcagacagttgatcttgcattttatggacactgaatacatggaagtagcatgagattactgtgagcattcttgcagttttgccaattctttcaaggtcatatatgtctatgattcacatatgcataatgaatgaaatacctctaggagagaagcaaattaggtgtttgtgtttctcttctttccaacactatccattgtcttttccagtctttgtaccacttacactttatgtgtcttttcattctccattcctgtgagaactcatctcctttggagtccatgtctctggcagaagaggcataacaatttggaccatgatttcgggcattagtaagtcaaaaatgattgagttttccttaagaggttaattatgtttaaaaaatcagcacaaattgttgctttgatattttatgtcaatatttccttagaaatttctccatagacttccaattatttggcaaaataagtagggtttcttttgttgttgctctaatgtataatatgatggaaggcctaacagctgaaaagtgagtatccatttattaaagctctactaagtgcataaaaacatggtaaatcacagcacatggtggaaagcactttagtaaggatatagacaaagacccatgggccgtagaagaaatctgaattatctctgcttaggttagttagtgaggctttccagaggaagtggcgtttgaactgcactgtaaagaagggaaaagattgcaccattttcatagtgtttgtgtgttgtaatataaatatgtatacatagtgcttggcacaaagtaggcaataaataaatcattgttgactgaatgaatagataaacaaacatgggtgaggatgtagcatgctaattttctgtatcaattatattcaataattactgaactaaaatagaaaaaaattaataacttttcttatcttccatttccctgtctgtctctccctaccaagatttcaaagctggaaattatatgtaggccatgatcaaatttgaaattttatttgcaagggagcattttataagaaccaataacatgttgtgtggggaagaatatactttctcttctcttggactatataatgtactgtgaagagcactgttaaagtgctctttaaagtaggtagagctctgtttcatttgcagtcttagtttggggatttgtttagattttgggatgtccatggtatctctatgttgctgtttcacaatgaatggttggaaatttaaaatttagtctttaatatgcatatttaaaatatatacattatattctcattcctttcctaaaaggaaaactaaatttcaccgattttttttaatgttgttcctgcctgcttatgcctcccagccccaaataaatcactaagtttttccagcacattacagcctaattctagtcctgttcttgggatccattaactcctcctataactttcttaactgtgttcctttgtaaggagtcgagatacagaacttttgtttaatcgatttttacgtaactttagcaggattcaatgcatacacaggtggaagtatattatcatttagattttgtttgtttgttttgtgataataagagaaccatacgcagaggtgtgaatcaagccatatttggctttcccttcttgtaagccattatcataccttatggcctcattcacagatggcataattttttaaagagtttcctctacctgaaaaactttcattttagtaaagtactcttgaaaataagtagctttcaaaatccaaaaggattaatttataatgatagattttagctagtatgagcaattgatggccaatatgtagagtaagttgaaaattaattgtagagaaaactatagggaatggaatccacagattagagaagccagctgaagaagaggttggaagtgattgttgataaacagaccaagtggatgataccaggaaaaaagagaggagaatatggtggtttcagtgactagaaaacaatttcagtcaactgaggtcaccagggattaatacaatgatacggtttcgctgtgtccccacccaaatctcatcttgaatttctatgtgttgtgggagggaccaggtgggaggtaattgaatcatgggggcaggtctttcccatattattctcatgatagtgaatatatctcatgacatctgatggttttaaaaaggggagtttccccatacaagctcttttctcttgtctgccaccatgtgagatatgcctttcaccttccaccatgattgtgaggcctccccagccacatggaactgtaagtccaataaacctctttcttttgtaaatttcctagttttgggtatgtctttatcagcagcataaaaatggactaataaatacaactacccaaagactcctgaagttgacagctatatataaaaaaatattggatagaaggtcagttttgcattctgcagtcatatctttaaactatacgtgcatatgcctacctttacatgcatctcatatgcatctctgttgctctttctttctttctctctctaactcaatgactaaactaaatggttaaactgtaaaatatttatgtatgtgccacagggttaatgttccatgatgctccacaagtaacattagagagtctctaatttttttatttatgtaaaaattatttttaaaatttagaccccatcaggaagagataaaatgagaaaatcagaatgtatctggctaaatatagtggccagtagccaggcacaaggcctactcagggtgggagagctagcaggtcagaaaaatacagtttgaagtcattcagggttagtgagtagaaaataattatagaatgcatctgatcacacagactcctaaataaatgtggttgaagaaagaaggatgtctgtcctgaaaatggtaaacacccaagagggcaggcatcaaatacttaaaggaccatgaagtagaaaatgaattacattatctttttctgtgtttttgaaaaaagtgtggggactggagaagaggctgtactgtgggttctagaattttcatttcccacacataaacatggtcattacctaatagagtagaattagaattaatggatagaaataacatgttagatatttctgttaaataaagcaggaaccttccaaaactttgtgctgctcaaggatggcatgtgccacctgtaaaagttgagattcttcatctgcagaggtttagctcttaattgaataatcatagttggaaggtattgtaaagtgatgcaagccatcaattttgattagaccatgtttacttaactctttgattccttccttccctccttccttccttctttctttccttcctccctccctcccttcctttcattcctttttttctttttgtttgttttctttctttttttttttgagagagagtattactttatcacccaggatggagtgcagtggcacaatctcagctcactgcaaccttcacctcctgggttcaagtgattttccttcctcaacctcccaagtagctgggattacagctgcccacaactatgcctgactaatttccatatttttagtagagacagggtttcaccatgttggccaggttggtcttgaactcctgacctcaagtgatccacctgccttggcctcccaaagtgctgggattacaggactcagccactgtgcccagccaactctttgatttcttatttcctcatctgcaaaatgggatagtgccaaagtcacagttttagtgggaggtagagctgatatttggaatcaggatcatcccacacttgagcagagttcttaactactatgtaatactacgtcttctatcaactattagaaacatgtcttagaacagggaaaggcacatagaaagtgtttagttttagctattgttactactattgtatatttaaaatatttagaatatagtatagtgagtacaggcggttttactggctaagagtgaagatcctggagtaaaactttccaatcttgactctatcatttactaactgtaggactataacttcagtgtctaactatcttcatctgctagttggggataatcatagtacccacctcaaaagttggctgtaagttttcagtgtgataataatataaagtccttagacctgtacctagcacataataagtgctcaataaatgtcactttattatgagtactaactacatacaaatgtccatgttaaataaaggcagagtagaggaaaagtgtcaaagacgaatatgatacaagaaggccctcaaaggtgctttcagtttaatgaggaagataagtatgcacacaaatactgtaggaaataaatctctgtaggtctgtgttggaaggtgatgctcagagtagatgttgagtagtgctaaatatgagagtagccattaaggttcccaaggggaactttggtgttaaaatgagggcacactgtatcacagaggcccactgtgttttatgagcatgaggaaaggagaatggccagttggaagaaggagtgtctttgaaatctgccccaacaatgtgattgatggtcaagcattctggatataagatgttttattttcaagtctttgcttgaggttctcatttatgagcacacatattgctccttgcaaaaaaaaaaaaaaaacaatttgatagtgccaatagttttctttcattatggaagactcaaataagaagtttcacaagatgctaaccttaaagattgagaggtgatcaatatattaaacaataaatatccaatattcagcaaatgatgcatgatttcaccagtggaatatgttagatataaatagtcagtatactgttgccagaaaaatgcttattggcatgtgaaataatcaagtaaaattcttgaaagatgaattacattcttgatttgcataacttggattcaatacatttacacaatatttgcattggaaacatatctaaagccagccaatggaaagaatacatgattttactaacatgcttatacattaataacattacttggcaatctgatgtttcaagacccagggtgaattacttattaaaaacccatatacagctatctgtctttatctttctttctgtatgagccataatggctctgattgttttcaaaattatatttggacaggatatgactgctacatgagacctctcaaaccaatatcatttccctcactcataaaatacattatactgctgtgtgcattgagccaaatcattaatgaaggaagcataccctaacctttgtgtctctgatttgaccagtagttacactgaagcaagctaacatcttggaaattgtttaaaaagtgaagctaacacgattatgaatatttatggtacattcacttatttcttgaaaattcatcctgccatctgaaccatttcattattcttaactattttctaagaggcttaactttgagatagaaaaactatctgaatcttacattatttgtaaaaccaaataactgtattcctggagtacaccccttctctgtacttatttaaacatgcaatagctacaataactagttaaaatctgtgaaatgtgcaaattaagaagtacattaatacagtattaactttttcagcttttaaaaaatatttggaaggcaaccattgacttgctattattatcttaaaggactgctgaagtttctatttagtagctgaaaccaacattagcaaattgctttatctttagttttatttgcactttgtataatgtaaatataggcatctgaatttatcaatgactggaatttttgcacatacagaaaatgaaaaagtccatatttgagattaaaaataactaatgaccttgagttaaggattagttacatacagttctatttaattactatttgtatcattttccaaaaatagtcttacaaaaataggaatacaatgtgaattctgcctcattgatgtgagtatgtgtaacctgttacttataaagtgtctgtggtttgaaagaaggaaatatggatatgagtaaatttaagttagaaggtgcaaacagatgtggtacgggttggcacaggggcctcagattgcagaaggcacccaataggctcgtagcagatgtaaggtgtggtctgtggatgtatttatttggctttttacagtcattttttaatgtaccctgaaagggtaggtgtggatggaactgtgtctgaggttcactgttgtgccttcctctccttattgtgttcactcatttatgacacctgtttagttgacatttgccttagctatacttgatttaaatagtgatcagagaacaaagaaatctgccttgaagagagaagtcttaaagcattctaggatatatgattgttgatcctctgttctgaaaacaagggcattaatggcagcagatggtttgatggtgagaaaattaccttgcttcactaaggtatatttcatggaaatcactacgacattattctagaaaatttgctatttcagatacctaatgtaatcctgaatgatttaagccttggtgtttgtcattttgccggttatcactttattctacatatgttattctttgtaattgaaattggtttaaagtatacaaatgtgtgcttagtaacaacaatcatttgcggggtacttaccaatgtttccaaattggatcctgattttcagggcccactcacaaaacactcaagcatacatcatacaaaattatggaatttagactctatcgaaggttattcactcatgggcaaataacacatgagtgcagtcctctcttctgctggatgaattcctgcaattctaaagccaggattcattaggagtaaagaaacagacctgcactaaacagtgatttggtcataagagatgtccgtgtaacagttccagctgtgacccttatctttggagcagacataagcatcactattccttaactgtttttggaaggaagctgcttccctcctggctgggaatttaaaaaagaaagaataggtagactgatttcccttttgtcatcttctccactgtttcattttgctaaaaaatattctccatttacttaagtaggatgttctgacagaagataaaatgagaaagtgtctaatgatgctttgggctgctacaaccccctcaggtacactgatatccataagagcaataaaaatgtttaaatagttgttttgcacagaagtttttgggaagtcagagactagagagatgcacacgtcagggtgattttctgcccctctggacccagggtctggagctgaccccttagctgtcagtaaaatatgaggcatctgttggtactataagaatgagggattaaagtaactcagtattatttagcaccactagactttttgcagggttgtttttgaaacattgggaatcttttggtaatacacacacacacacacacacacacacagacattgcagaggggcagttttgcacagaggatgctagagactctgtcattggcaaagtgactccttggggcaagattggccatagtgaagagacatcgagaggattgatgtcatcagcattcatgagctttcactagattcacagaaatgactgtgatggtggctaaatttgggattattaaccaacccatttggcattgttaatgtcatctcctgtggatccacccatagaccggtgaagtcccaggacatttgagttatgcttgtggctaataataatgcaaaacttccattattcactttgactgtgacatgaaatcacatggcactgaataatgataaagtaaactgcaaaaagtacatccaagagatgctgagagtctgccttaaattgcaaaaatgttgagtagaaagctgaaaacctgccaatgcccatctatggtttatagtagataagccattagtcttggctaggtatatcacttcctacattatcgtgcatgcaaaatgtgaactcccaagacctgtggggtgtttatcatccaggagagataagcccttaagaaagagcctgggtaaggtcactgtctcagaaacagatatggtttttggaagttgctaataattgaaaaacaatggtttggaggcatagaacatattggcctagttaattaaaagccaattagtgccctcccccatatagaccagcaaataacctacaactaacctgctacatccttttgcaaatgactacaattctaaaaacttggaatggagaattctaatagctaagattgtttcagtaggaatttaattgggtcatatcacacaaagatatccactgacatggaaactgacatggaaaagcagcttctatacaaaattggaaaatgggctaaaggtattgattagttcaaggaaaatagagaaagaaaagctttaaatcaaatcaaggaaagcctgtagtatgtcaagattaaaccagaaactgaaaactctgatataaattagagcaatgttttgtgagccctcatgaaaaacaagaacactacgactcagtttggcattctaaagaacaattcagctaaatcatttcctttgtttttgtagaagatcattcaaataataaatttggacatcacctacattgacttatccaaacatctggcactttttcttatgatattgtagataatatgcagaattatagatgtggacattttatggatttataattatttcaacaataatatccccaaagactgagtcaaacaacaagtttaatgtagaaggagagcacagtgatgtgtcatcaagctttctccccatgataccaagatagtgcagcgtctaaggagcataccagttaccatggtgataagagaatttactgatcacacttcatcagggctcattgaccagtgcaactctctctgattgtctgttccacaggggcatggggaagcaactgtctgttaatccacaagcaatggaaacagtattgcctgaagaaaatgactaaaatgatagccaatgaataccaatataagtattcttaaaaagaaaaaaaatggcaagtcattagaaggatgttattaatctatttcagatagccaggaaaatatcgagatgctaaaacagggaaatacactcataaccttagttatttcagaaagagagacacctaattgttaaaactaaggtcaaaaaatccattctgtaattggaattaagttgagtgagtccatcaggacaaattttttcactctgaatctttctggaaattagaaatgccataactgaaaacagctgatctggggaagataaaggtaactccaataattttgtctatttgggaactaattaagggaatgcaactttggaaaaaagaacttcaaaggtggacactaaagggaagatgtgagcctctgtaaggacttcaaaattagaagtgcatagacacagatcccccacctccccaatttctcaggcaggcaagattattttagttaccaataattaaaaacagatatactccagtgatggaagttttcaaaggtgagaactttttccaattagggtccattttaagttaatcaggttgaaaaaaactagctgaggtttccttgtgatcgcataaagcaggagtttatttggtatttttccaggtaggctgatgcttttagggaagagctgctgcagaagcacagacaaatcattggagagtaccttgtgaaaatggctgcagatcactgaggacattactcagagtcttgttctggaagcaccccagagaagcaggttgggaccacaaaagctttaccttagaaagtagattgacatctggagaaaaattggacctatctacttcttttatgagggcaggaactgagtgactgtcttgcttttcaggtatccacatcacctaacacaatgcctggcaaataaggaggcactcaataaatctaattgttcaataaattcaatgaatgtcaaatctcattaagagagagagattagtgagattgagtgattgattttgagctagtggaaaaaaatgcaggggaagatagccagcaatactttgtatctatgtaccaacactatgctacttgttttacatatattattttacatatattatctttttaaaaaatagtcttgataaacctcatttttttattcctactttacactggaagataaagctcaaagaaattacagatcaccccaggatcacactgttagtaagtatcagtgtgatggttttaaaccagttgtgttgggctccaaagatagagactttacactacaccaagttttagaagagctcagtgatttcaaaaaggagcagatttactctcacaaagcagtagttctctatctctagaaattatagtagctttagagttggaagggagattagtgatacgcttcaactgcctcttgcaatggatgagggattgaagtcaagagaagtagaggcatgctcacatgcatggcaagaatggggcagcataaagttgtatgccttcttgcgtactgccagcacactttcaattatttaccgaatatctgtctttcacaccaaataataagttcgatctatgaagtcaggtgcattaattatcttatttatttaatatctcaggacaaacctacataataatatatcaataagtatttaataactgcatagatgaatgactggaaacagtacttgaacccaggtttccaaacctgaaatgtttgaacagaaggtttgtgatcctttatcagtggtgttctgtgttaggtgtgacttgtactagatagtcaccatggtcccttccagaagtaacatctataaaattaaatcagcctgggagtctctgatctttatgcctactgcaccctatctatacttctattttagcatttattgaattgcactgaaataactgtttacattcgtatttttcttaccagagtaaaagtatatgcgagttgagactgtgtttttatagtggtttccagcacttaccacggggccttataccttacaagtactcaacaaatgttcattgacctaacgtgcaacaaattcaactaagattctttgaaagtatttagatatctatcacattgtttctcatgttaggtactcctggttgaagatttctttgtgagaatgtgtttactgaattgattggtttcccaacttgttttttatttaaacagaattagagagaaagtgagatagggcattaaaaagaaatctgtgatactcttggcttgcctgacacaaggctcttcacagacccaggtctccttttgaattcagtgttaattctgcatttatagaaagatctagtgctcaggattagcttcattaggcagttggacttgaacagaggtggcaggagatcaggaaggacccttttagaaatgggcacaaaaagacgtagtgtgcatagatgaattctcctttaaataaaaactgagtcagattttagaatgaaattctgtagtgctgtcaaactgtttgaaactggagttggcagttgtcctttcaaactgttatttcagagcacgtgtcccagaagggacagctaagaatgtttgtcatatttgaactctttccagagccattcagcaggatactggcagtccactttctcgtgttaattatttctgccctgattgcctggcaacacataacatgggaagtattatattttgttatttgtgaatgcttccagctgaatgcaggaagaaaatggaatacaaagtcagccggagatgcaacttaataagttaggtgtgttttttgattgaaaatttgtgatggatgaagaagttcataatcccatgattgtgcatgttcaccacaatttcagagagtttgagagtatcacaatgtgtcttggtggaaatgaaatactgatggatcttaatgggcaccagactagaatctatgaacatgaattgtctcctccacaggcaaaacagatttgttgtaagcagacgttgtttcatccttgaagagtctccttccttctctccttctttccttccttccttccttctttccttccttcgtttctttccttccttattttttgatgtgattggactctagaattgagttcaagcataaaaacctaagatcaagtatgatgggaaaagtgtcatcattgtaacaatagcaacaatagtaaagattgctgtaaactggagagcaatgagggttttgatcagtgactaaggcctagtaggagcttctcaccacaccattattagaaagttctgcctgttgatgtggctcagttaaaaactgctatctagaactgaaaacaatatacagttgacccttgaacaatgcaggggttggggcactgaccccctgtgaagttgaaaatccatgtataacttttaacgcgcccaaaactttatctactaattgcctactgttgaggggaagccttattgataaatacaaatagttgattaacacttttttgtatattacatctattatatactatattcttacagtaaagcaagctagagaaaagaaaatgttattaagaaaatcataagagaaaatacatttaaagtactctactgtatttattcatactgtaagtgtatgtcttctgtttacaagatgcgttgtctatctaaagtggtgggcaaccatagctgcagacctcagtcgacggtataaataaagcagtactgcaaaaaaaaaaaaaaaaaaaaaaagatgaaaactacatgagaaccataaaagaacacttttaactgtgtaatgcaacttactggtgagaagaactgctcacctggagatgattagcatcacacaggtgatttaaggggatactcacaacacttgagctcactgcaatagcaacaggaggtggctacaaaattattacagcaatacactatatactgcagttaattttatgcagttatgacttaattctggatctttaagtttgtttatacatctctctactgccaatagtgccatatatggtctgtaagtgtttgagttttgacaaattttaactgtttaaaatagatttgtgtatattttatggcagttaatgataaaatagactagtatctaaatatattttttgcattcatgacatacttaactttttcttaattttttccccatagttttagggcaagttctttgcctttgagttttttcaagttgtcacagatctccaaaagatttttcattatattaaaaaaaatccatgtataacctgtgcagttaaaacctgtgttgatcgaaagtcaaatttattcactcacagcattggaaaacaaaggtacatttctgaattatttccaaaatttcatttttttttaaaaaaagtgattctctgatagttttcttcttgctgtgttcattgaagccacccctgagtgacaatttcaaagatggtagttttgcattctgggctggtgggtgatgtgagacaatgatccaatggaaattaattccaaaaataaattgtaaaatacaattattaatgtgttcagagatacatttttaatggatgagagcagctttttagagctgtaaatgctcagttatcaatcaatatttaaaagtatattaagatcaatgttgaaaaatatttttctacaacaagatttcaaacatttatttagacttttagattgtcattttctcaacaacactaggtgaaaacaaaaccaaaactagaaaactaaaactagacccccaaatcaaaaacatattcttggatgagatatactcagttccacacatgaacatttctgcaaaaataataccaaggcgaggtgtggacaaaaaagacagcagcaggatgcattcctttcagatctgctgtcatccccattaggcctactttctctcagaattagcttagggataagaaaaggaataaaatggtgttctcacataattattgtaaagattaaattaagtgtggaaccccaagtttcctaaggtaagcttgggttaaaaatgggattaccgtttcttgttctgcaccctacccactgtgccctgccatctttactgggtcatatctgtgccaaagctattctagagtccccaaattgccaaagtttacagattgtttggtggcaagtggagagaaatgctgatttcacctttttgtgtaatacccttagataacggaacagtgctgtttctattctgatgtgttataaaattcttagaggaacaaaaagctcttaaaacatttcaacctaggctcttcatgaaaatttagacacatgttcgtagaggttaccctatgaggcaaaaccatgtgaaaaaatattatattgaaataaaaatcctccctctacctttagaccaatcttttctctccaatttaattttcccttggatgaaagtcctctctgataagatttctgaatacctcatacaaataaacttccggaaggctagctccaatgcatctcacaggacagtgtagaaatatattaatctcaatgttaaatacaacatcataaagatgtggcaattgtggtctggagaccaaatctggcccaatgcttgatttgtatgaccagccagctaagattggtttttacattattaaagggctgaaaacaaatttaaggaatattttgtggtgtgagaaattcaaatttcagtatccacttaaaaagttttgttgtgatacagttgtgcctgtctttttatgcttaagagaaagttaagtatgtcattaatgcaaaaaacagtgtttacagatgtttcatggttgtttatggctctttttgcactctagtggcaaagttagtggttggactaccgtgtggcccatatctatataaaatatttatcatctggccttttacgggaaaagttatctgcctctgacatcaagatggaaccactttatgtcatcaccaagacataaagacttcactggtttaggtgaaggtctatagtgcagagtttggcttttagaaagtgctcaataaacattagatttaggtgttccttcttaatatattaattgcagtttagcctttagctcattattttctttttctttcctttcttctttcctccctttctccctttctctttcgttactcctttcttttacctgaaatagctttaaccatcccttatgaatatttaagtcatcctttaatttttttaataacaaagaagtgattttaaaatatttaagccagattagtatcttttaaatattctattaaatgcattttaatacactctaataacagtcaaaacatataaagtcactttgatttttctttcaattaaacgtgaagcatggttgtttcatttactttaggtaaattgtgctagaaaaagcatgacttatcgacaagtacattttaaaatattggtttgaagaccaagagttattaaaatgtacattgaaatttaagtgtttttataatattaaacatagacaacaattgcttttatgaactgatgtttggtgtttttgtactttgtgtttttttctttctttataaaggaaaaggcaaacaacattcatcaggatatattcaccttttaattttgatttttaaagtaatagtcatatcttgatattataaaataaattggtttagatgaattaacttaattgaccataaatatcttgaagatagggatgtatcattttcattttcacattccagggcctagcaaaatgcatagttttggagtgattaaggaatggatggatgaaataattatctctaagtttagatgacactaggataatcttctatcacaaacatcctcaccctcttatccatgaaatgtcttaacttttctcaaccccctctcagaacagtttccaggccctttgattgctcttaattttcctggaggaagttattgcttcctcagtatgaaaatcttatcttttgacaggggattctgccaccatcctgaggtagagaaaatgtgctctatcaatttgtttgaaaagacaacatgaggttacaagatgcaatgagcttgtgctgtttgttttccatattggtggtgttcaaacattttgaatgtacacctaattcacacagttttttagaatatacctttatagatagatgaatggatgaatgcataaatagatatagattgatgagtacatatggatatggacaaatacatttaaataagtatataaataaataacatatttcagaaaattcttaaatatattgtctggagataactagtattcatagatagagtacaaaagattttcacatatactccctatcttatttcaagtaattatgaacattcattatagaagacaatataacccataaatcactttaaaatatagtaaatcacagtattctgagagttaacaaatgttgggctattgcatatgataggaagctgggtgacatgtgtcctagtatggatgttggtgtccagatgtataataaatactattaaaataatctttcttacattttgtaaaaaagtataaatataatttctttcttagttttttaatgtttatggattcagcgggtacacaggcaggtttgttacatggatatattgtgtagtggtgaggattgggctcctagtgtacccatcacctgaatagtgaacatggtactcaacagataaattttcaatcctcactcccctcccacctttttggagtcctcagtgtctattatttccttttatatgtccatgtgtagccaccgtttagctcctgcttataagtgagaacatgtggtatattattttataatttcttattccagtagattgtcctgtacatctcctgggtagaagcagctcatttctggaaattcttattttgtagtacatctggaaatatggctttttcagctcattatatttcttccttcccttgagttgggaatttggtaaaagtgtgtgatgatttatgccagaggacagatgggaatgaactctagtatgctaccttaaaagttatctatttgctttgtcacctagcaccaatcctggatactttgactatcccatcagaacaacttccttttttgtttagaacatggcctggaaggctaatgagtggcagtcattccttagcaacccagaagcctacgtgtaagtttaaatggatatattatctatttctcctagaaggtatcaggccgtcctgcaaataaaacacactttaattatattcactctacccactcaagcattgcctgtgttttccttggttttgagagttggaggttgttctgggaccccaaatacactagtaatattgctggagtctcattctttttttatcatttcaacacttattatagattaaatagtacatttgcaggtttattagatgggtatattgcatgacactgaggtttgggctacaaatgatcccatcacccagttagtgaccatgttaccaataagagttttttcagcccgtgctccccttcatctctcccctgtctttagtacctctccagtatctattgtctatgggaattcagtgtttggctcccaccaataagtgagaacatgtggtatttggttttctgttcttgtgttgattcatttaggataaagaagtctcattcttggtaggttgagagcagttagcaggtaggagatgggggcaaaactgggtaagatttgtcctatatgctagtttcaactcttttgtcaatgtttagtcatagatgggcaatactgaaagggttggaaaatggtgggtgcaacttttttagtggtactttggtgccaaaattgatactaagttttacattcaaacatcatcctttattaaagtggaaatagcaaccaccaagagtcttactaacctgccccaaatgcttacactgccactatcagaatcattctctggagctaagatactcgttacacaggagttaggataggaagattaactttagaagcatgttcatttattcaaaaatatttctttggccttagctgtggtagtctaaaaaattatctatttggtacctacttatctattgtgtattcactacttggccctggatataaaaataacttaaatgccaaagaagtaaatctcagtactttttaattcataagttaaatattgagcacacactgggcatttatttattattgtgcaaaaccaaaagaagtagaaggaggttataagacctattctatttggttgagtgggtcctgacagaatagtcactttcccatgaaaatattgctatcttttttactctttgggacatccatatgagaatttgaataatagctgcattacaggtgtgaagatttagtttatttatgctgataaaatctctagataagaggtcttcttaggtaaggggatcatttaactgtcaagtagagagcatgcttgcattcatgttcgtctattgaataaattctactcagtaaacactgacactgactgggtctcattaagacaaagtaataacattctgtgccaacaaatatcgtcttctcaagtatgtatttgcttctacaagatcaaaatcctgcttctgagaaaagttgccagtgacatgtttaaaagacctatcttaacaggaaaagttacaaagccaagtaagtttaattgcatgtcacctcttggttttgacaaaatataatggcacaagttgctagtaaacttaattatgtagatttattttagcttaacaaaatatatgctatatgtagtaagtagctagctatgagccaagttttaactttttttttgcagtcaaaatgcttatgaaagaatgatttaaattaatgaaatttatcagtgtaattgttgccaaaagcaattttaactggaaaaatacctttacccatggttcaaggaaaaaaatatatgcacctctttcaaacctgtaagcagaaatttgctaaagatattacaaatttttccttggccttgcacctctgccaaaactcctcagaatttccataattacttcgtaattaatatagctcgactttttccaagccacttcttaaaattgcttagagacagagattgttagctaaatgaagattcatgatcttttgatgaccattccctgcctccccatactcctttcccatttcctctgtgcaatcacccttctttcatatacccacaataaaaaacttggatgtattcctgactctcccttctcttttagcaccttcccatcagtcaccagacactctgtcttctttcttaaatattttccgatgtcaatgcttcatgtgcattctcatttctatcaccttactctggttctttatgttcacacaaagacaattattctttcatttacctcccggtctgtccccaccaatcaacccattacatatgattaatagtcttaaatgagactattttatcactgccctgctaaaaaatctccagtgtttctgtacatcttacagaaaaagttcaaatcctcagcgtggcctttaacttctatattttagcctttctctatcaatccaccttcattttcattctaagtttgtcactatattctgaccatggcattttctgcttttatttccagattttcttcatagtaatcccatttcctgttattgcttctcactaatcgaatttttctcaactttcttgatgcagttgaaattctaactcctttccagcttctctgagtcttccagttccaatggatctgccttttgtaagggatctcagaaactaggaacatacacctctgcgtggtacaagaagaagaaattgagtttcggaaaggttaactaattagaagcaaccatgatttgagccccttcactttccttcctgttataccttggtacctttctaggctgcttaaagaaatgacagtatttgagttacttatctttctttttggtggtgatggacatactgccctgtattatcgctgaactatttcatccatatgtgtttgtttctctctattttatatgctctgagaaataagagatcaggcatcacatggatctcagtgctaaacacatttaagcattagtatacatttgttggttgaaaggtttgaatgtgtcctttaaattatgtaatattctaataaggtctctattttttcgctatcttgttcaagttgaatataaaatcgtatcttattcttgaagaatggcaacctattcagcatttaactaataatgtagcaaagggaatagagattggaataggattagaaggtagaattcagacatttagattaagaaataaatccctaataccttacttcaatttgcaaattagaagataatctttgaaataatatgaaaatgaaatgttttgccaaatcattggattttctctaaaatcatttttgttatatttgatcatatattgttggattaaggagaaatattgacataggcatatctgtgtaattattcccttggcaaataggagatattttgttttgtttttctttcttactaggagtctagtctgtggtctacaacacctggggaatagccaacagctaactatctaggcaagcttttgaaacatagaaggatacttgagagctagcttcttctaaaatcaaagaaattcttcttgacctattagacaccaactccttatattgttgccccattagggataagctgaaatttatctataaagtcagcaaaatctaaattaataataaggcaaacagttttaatttaagatggaaaaatatattttatctcattaagtcccaccgtcctaatgagtagcagtgatggcctagaagagttaatgcaaagtcagtggaacaagagttaagtttttttaaaatgtcattttccatcctgaaaaagtctgtgtgcaacagtacatttctcactttttgtaagtcttggaaagacatgatatttttctggtttcgtcagcagtgaaaatgccttcacacaggcctgtagctgatgacattgtagtgaaagctctccaaacactaattggaaatttaaaaaaaaatcttgacaacacctcactgcatcatagttatgtttcatcaccttagacattcattatcactcaccacatacacatatgttaatgggaaaattatttcgaattgtcttatattgcagagtcaagccatttctctctctttttaaagtcatatttaattgtttttggatggctaacaacttgtggtatcaagttgtaattttatacatagattattgtgcaaaatgataaggaagccctaatttttttttggagggaattcttcagggaatgtttttccaaagaaaaagatgaaatgtattgatttcctcacaacagtaagagaaaaaaaaagtcgactctttccagatttatataatttattagaagattaacactagacatatggctctaactcttcttactctctgaaaagtgggaatatgaatgcacatttcagtggttagaggatgattagtgagaaactattgaaaaagatttatagagtacatttcaatacatgaatacatttcagtatttgagtacaaaagaagaacaagaagaaaaaataatgctcaacttacacaggagtcataaggacttcgggatataatgcagatgtagtaagctctcctatacctgttcacccctttgtatcccacaaggttttattagctctttttgaaaaaatgtaaacaaagaagtaaaagattcaatttgtaccttattcatggaatgaagtttacatacagaaataagacaatatacaaagaaagataatacttttggccctgctatctgctctgcagctttagtataggttctggctttgcagagtcctttccttcaggcatgtttagaatcgcctcagtgtacacggggattccccaaaggaaatgacatctctgctctccacacaaagtgtaggtagaggatatctcataaatgtagcatatcacatgttctaattcatgatactacttacttatgacaattttccacctttcttcctgcccattcatttgtacagccctgcatttctgcatgaaaatagttgctgtatcaatgtacagagctactgcacttattagaatgttggaggaggctgtaagtcagattcttaaattcttcacgctctaccttttgcaattagaaatttgtgacctggaaataaaaatatgttaaagatgtattatcccctaccattcattattaaccaaatcaagttaaaattcctacagtagctaacattaactgagtacttattacttgtatggcatctaagttaaaaaacaagtaattcctcaagcatgtaggaaagaaacagacagttttaccatggtaacaagtatatatcagaactgtttctaaacttatttaatgaataaatgacaatttgtttcatttaacatgtctctgaaagccagccaaccaatgacagccttcaaagctggccaatcagtagtggacttactccagtgaatatacttttaaagctgacactgatattagcccgctcctacaacataaaccacacttctaagagagatttagagaactcctgccttagtaactaagacatctgcaaattatgcatttcttaagtaccctaataaatgttcaaccgtttgctttgctcaacgagcctatgcctgaccagcatagatcttacttcaggatagaatacattcaacttttccacttcagattttgagtactattgtctttctacaacaaagtattaactaatttaattctcctgtcagctctgtgaagtagataccgttattctctttattttagagatgaaggaactgggatacaaggaagttaaggaattttctccagcctgctacgactacagtgccatagctggtgagagcccaagcagtctggctcaaagtctggacttctaaccactttgctacactgtctcttatgccttgtaaaagatgtccagaaaagttcctccagtctctcacaggccagaaaaataagcaaagatttagaaaaacaactgatgtgttttcccctttccctttttgcagtttgaggcaagagtgatttatgaggatgtggataaaaagtgaagcactttaaggtattatttgggggactgtaaaatatgaaatcatcaaaatatggattatttgtggctgaagagctacttggtgaataaccttttccatttgtgaacctctgtctttcttgattttcttttttttataagaaaaaagtctcctgtgattgtaactgccagacacaaactgtaattctactctgcttttctttcaaggctgtttggctggaagtatgcaatacccaagcatggggacagccaaaattttataggctgaacagtatttccttagtgaagaaaagataaactattaagaggtcagggagtttggtgtttcatgactgggtgattaggaatgaaataattatgcatatgttcaaaaatattactgaaaatttcttggtggtaggtgcatcatattaaacagttattaaatttaaaaaacctcaaatgtagaattagagaatagacaatcatgattgctgtgagtttctccagtaggcaccaaaatatcattaaaattaaaactgattaccacaaagaacttttaaaactcaatgctaagaaaactaataacccaattacaaagtcggcaaagatctaaatagacacattatcatagaagttgcacatattgcaaaaaaatcatatgaaaagatgctgaacatcccgtcattaggggattgcaaattaaaaccagaattcacctattaaatggataacattaaacacagagaacaaaaacctgaaaatactaagtgctggtgagtatgtagggaaaaggaaactatcatacattgctaattggaatgcaaaatagtgcatccactttggaatacagcttggtgatttcttacaaagctacacataattttaacatattctccagcaatggtactcataggtatttacttaactgatctgaaaatttttgtccacataaaacctgtatgcaaatgtttatagaagttttctcgtaattgctaaaaactggaagcaacaaagatatccttcagtaggtgaatggataaacgatggtatgtccatacaatagaacattgatcagccataaaaggaaataagctgttaagtgtagatgaagcttaaatccacattgctaaataaaagaagccagtcttcttttagaatacatactgtatgatttcaatcacataacattctgcaaaaggcaaaactaagtaactgtaaaagctcagtggttcctgtagatttgggagaaagaagagaagattaaataaagaatacagacatttttagggcgatgaaaccatgcagtttgatattgtaatggtgcatacatggcattatgtatttttcaaaacccattaaattttataccacaagaagttaatcttagagggtgcaaatttaaaaaaaaaaatcatctaggatgtagtgtactccaggatgaatgtgatggtaaaagaagaaagcttctaactgtgttactaatgaatgtaacaatctcagtgaataagataggaagaaaaggcgctgactaagtaactttggaaatatgtagagtctgtaagactaaaataaaaggtacttgtatgtaatcactatattctagttgataaaattgtttctcatgaggaaagggttgacaattcttatgaggaaaaggttgatatatatatgtatatattatatatatagatgggtatatatatgtgtgttagtgtttgtgttgtgtgtgtgtatatatatataaatatatgaatggagcaattttgttaatggtggatggtgagagccaggtatctcactgttggagtggaagcaaggggaggaagctacaatgatttgtgtgataataaattagagttggtgacatcagtatgaacttatgtttagcttagtatagacagatgattatgagtagaaatattatagatatgagtttatacatggtttagtatacaggcatatatttccttgcttcctccactgagaaagcctaaaagtagtgagacaccggtagcaatgaacacttctagcaccgggatctttgcttctaataccattcttcaataatataaaccagggctctttagagaaatggctgattataggtctgggaagaatatacacaagatgagcctggagcatcttgtgctaaacaggaagtgctaaaaaaaataaaataaatggtggaagtatgtcaaagggacacaggagcaaatcaagagtttttcatggccaaagctaaaacaatttgagcaacaaaatatattaataagtgttgtattataactccaagtataaatagatattcttgcatctatgttgatataaataaataagtcaataaataaaaaggggagaagagacaaagcactcatgaagaagaattccaaataatttatgtagatacaacacactcaaggaggttgtgatggttaaattttatgtgtcaacttgactaggttatgttgcccagtagtttggtcaaatgacagtctacatgtgactgtgaaggtattttgtaggtatgattaacaattgtcttaatgtaaatgataatcaccctcagtaatgtggatgggctccctccagtcagttggaggccttaagagcaaaaactgaggtttcccaaagatgaaagaattctgcctcaagactgtaacatagaaatcctctgtgagttcccagcctgctggcctgctttgtggttttagacttgtgagccaccacaattttgtgagacaattccttaaaatgaatcaatcaaccctcccccttttcttgtgacctctttctctcactacccctccagctgtcccttggggtatttgttccaatacatggggtatttgttccaggacccctgacatatgccaaaatctgcacatactcaagttctggagtcagccctgtagaaacaaatatatgaaaactcggctctccatcaccttgggtttcacatctctggaaaaccgtattttcaatctgcattttgttgaaaaaatctgcgtgtaagtggatttgatcagttcaaactcatattgttcaaaagtcaactgtgtatattataatttgtgttttcatgtatatttattttaaggagttgtttatatacgtatgtatgtgtatatatatgtattctttaaagtaaatatatatatgaaaacttataaatatttatgtataaatataaatacatacacatacatattggttctgtttctctggagaatcctaactgatacaaaggggaagcaaagctttgtactcctaagtgtgggctgtgcactgtgactgcctcccaaagagtacagtatgggagtaacttagccttggagaaacctgatagaccctacctcagccaggtgatcaaggttaacatcaacattgataaagcacattgataatatatattcttgatgtaagatgatgaaagtggtaacttctgtgatctccctacttcaaactcataacccatgtctgattttgagaaaaatgtcagacaaatttcaattgaggggcattttatgaaatacctgaccaatattcctcaaaacttttcaaggtcattaaaaacaagagaaacttgagaaactgttacagccaagaggagcttatagatatgacaagtaaatgtaaaatggtatcctggatgagatcttagaacagaaaaaaggacaattaggggaaaactagggaaatatgaataaattatggactttaataatatatcaatattggttcattaactgtaacaaatgaacaaaactcttataagaagttaataatatgcaaagttagtgcaggcacatatgtttatagcagcacaattcacaattgcaaagatgtggaaccaacctaagtgtccatcagctaatgagtggatgaagcaaatgtggtatacatacacgtggaatactactcagccattaaaaggaacgaaataatgtattttgcagcaactcggatgtagtggatggccattagtctaagcgaagtaacacagggattgaaaaccaaaaaccttatgttctcacttataagtgggagctaagctatgagtatgcagaggcatggggagttatataatggaccttagagactcagaaggggaaaggtgggaggggtccagggataaaaaaactacacatgaggtacaatggacaatactcgggtatcaagtgcactaaaatctcagaattcaccactatataattaaaccatgtaacgaaaaattacttgtacccccagagctattaaaatttttaaaaagcgagtggagagcgtatgagaattctgtgcactatctcattaactttttggtatatgttaaacttctaaaaaacaaagtacattaaaaaattgttagtgttcaactatgagttaatgcaatttaagtacaaataagaaagacactggaacataccctctaaattatatattgttataggattgtaatgacagaatagcagattatgcctaaaaaacacctaactggcacgttgtaaacataatagaaagtttaaaataggaagctaataagaaagttaaatgaaagtaattttaactagaaggaaataatctaagaaggcaaagcaaaaatataagaagatcaataaattttactacagatggatcaatacaaataggatgctatttccactctcagagaaagaagagaattagtgtaaacagcaaaaccagctcagtgtcttgcattcaagaaaaatctggttagtttaactgctttatgtgtttctatacaatattttccccttatccaactcctaactggatttaaacttcttcaagtgataagattattacaccttttttgagatataaatgcattacagagtactatacatacagaggtatgtgagaaatatcgatttagagaatatctcttgtagcaaacaggtacttgctttttaaaatccagtctgaaaagatctctgattttagttgaagtgtttagttcatttacacttaatgtaattattgatatgattgggtttgagtctgtcttctttatttgctctttgccctctgtatttttctccttttgtattcaaattttttgcattccattttatttccttttgacctttcagccaatggttcatctaagaattgcaatacacatctctaactgactagcgtggttagaatgaatattatatgagttactgtaaaatataaattagttatgtattaagccactcgtgttgctataaataaatatctgaagcaggaaaatgtataatagaagaggtctaattggctcacagttctgcatgttgtacaggaagcatagtgctagaatatgcttcttgtgagggcctcaggaagcttctaatcatagcagaaggtgaaggaggagtaggcatgtcaaatggcaggagcaggagcaagagcaagagagagagggagtgggaggtaccacatacttttaaacaaccagatctcatgagaactcattcaacattgctaggacaacaccaagtcatgagggatccaccccataaccaaaacacctcccaccacacctcacctccaacattagagattacatttcaacatgagatttgggtggggacaaatatccaaactgtatcaccttacagtaatatattccacttatagtactctgtaatgcatttatatctcaaaaaaggtgtaataatcttatcacttgaagaagtttaaatccagttaggagttggatgaggggaaaatactgtatagaaacatataaagcagttaaactaatcagatttttcttgaatgcaagaaaatgtcttagagtcgtatatttcacatatatatatacacattataaactccacaataaaattttattgctttttgctttgggaagtagtttgtctttttcaaaaattaatagaagaaatagaaaaggttttaatatttacctgcatgtttatcatttgttattcattttttgttatagatacagatttccatattgtatcatttccctccagtgctgaagaactttctttagcagtacttgtagcacagatgagacaaattatctcagcttttgtttacctgcaaatgtccttattctgcctgcatatttgaaaaatattaatattttcactggatatagaaatttggtttgcttgcaccaatttaaagttatcactttattatctattgggcttcattatttcagatgagaagttacctgttagacttattattcgtttgtatgtaatatctgtcttctctggctgcttttataattttctcttcatctttggttttcatcagttgacaacaatgcattgagatgtggttttctttgaattttgaatttatttatctttgggtttactgagtttcttggatttataggtatttattggtatttttcatcatatttggatttattggtatttttcatcatataggatttattggtatttttcatcatatttgggaaatttggggcaattgttttttcaagaattttcttctgccccattatctcttttgttttttcttctttttgagctctaattatacatatttatactgttagtattttctcacaggttactgaagctctatttattttgcttttcatctttccccaccatgattttcagattgggttgcaatctgtatgttgggttgcaatcagctgtccagtgatttcttttttcagttcaggtattgtacttgccatttataattgattccttttatttctctgcttatattacagagttgtttacagactgtggacttatttgtaaaagcagtttaaagttccttgcttaataacttcaacatctgggtcatcttttgtgtttgtctgttttgactctgttttcctctttgatattgggaatattttcttgctttttcacatgtctagtaagttttaaatgtatactggtcattgtgaacatacaatggaggaaggctgaattatgttattttttaaattgttttattttgtcctggcatgctgttaaattcgtgttgggcactcctaatcttgtcaggcttagttttatgctttgttatcctaatcttgtcaggcttagttttatgctttgttaggatgggtctatttttttcttagtctttgggcataggcctcactctgtttgtagttttgatcctagagtctcttcttattatgtctcaacttattgcctcaggtgcacagtgagacttcttcactctggttgggcctaagttatattttttcatagccctgcatgatttacacatcttcatttaagtcttggttttgtagtagccactctgttatatcttgtattttttttttaacttttatgttcaggggtacatgtgcaggtttgttgtataggtaaacttgtgtcatgggagatttttgtccagattatttcatcagccaggtattaaacctagtacccattagttattcttcctgatcctctccctcctcacaccctccaccttccaataagccctagtgtgttgttcttctttatttatccatgtgttctcatcatttagctcccacttataagtgagaacatgtggtatttggtttctgttcctgcgttagtttagtaagaataatggcctctagatctatctatgttcctgcagaggacatgatctcattctttttatggctgcataatattccatggtgtatatgtaccaaatttgtttttatccagtctaccactgatgaaaatttagattgattccatgtctttgctgttgtgaatggcgtgttcaagaatagggctgcagtgaacacacatgtgcatgtgtctttatgatagaacagtttatattcctttgggtatattggtatttctgtttttaggtctttgaggaatcactgcactgtcttccacaatgattgaactaatttacactgccaccaacattgtataagtgttcctttttctttgcaatctcacaagcatctgctattttttgacgttttaacaatagcctttctgactggtgtaagacagtatgctattgttttgatttgcatttctcgaatgatcagtgatgttcagcttttattcatatgcttgttggacacatgaatgtcttttttgtaaagtgtttgttcatgtcttttgcccactttttttatatttacagtttttattttattttattattattatactttaagatttagggtacatgtgcacaaggtgcaggtttgttacatatgtatacatgtgccatgttggggtgctgcacccattaactcgtcatttagcattaggtatatctcctaatgctatccctcgcctctccccccaccccacaacagtccccggtgtgtgatgttctccttcctgtgtccatgtgttctcattgttcagttcccacctatgagtgagaacatgcggtgtttgggtttttgtccttgcgatagtttgctgagaatgatggcttccagcttcatccatgtccctacaaaggacatgaactcatcactttttatgactgcatagtattccacggtgtatacatgccacattttcttaatccagtttatcattgttggacatttgggttgggttcaagtctttgctattgtgaatagtgccgcaataaacatacgtgtgcatgtgtctttatagcagcatgatttataatcctttgggtatatacccagtaatgggatggctgggtcaaatggtattcctagttctagatccctgaggaatcaccacactcacttccacaatggttgaactagtttacagtcccaccaacagtgtaaaattgttcctatttctccacatcctctctagcacccgttgtttcctgactttttaatgattgccattctaactggtgtgagattgtatctgattgtggttttgatttgcatttctctgatggccagtgatgatgagcattttttcatgtgttttttggctgcataaatgtcttcttttgagaagtgtctgttcgtatcctttgcccactttttgatggggttgtttgtttttttcttgtaaatttgttggagttcattgtagattctggatattagccctttgtcagatgagtagattgcaaaaattttcttccattctgtaggttgcctgttcactctgatggtagttacttttgctgtgcagaagctctttagtttaattagatcccatttgtcaattttggcttttgttgccattgcttttggtgttttagacatgaagtccttgcccatgcctatgtcctgaatggtattgcttaggttttcttctaggattcttatggttttaggtctaacatgcaaggtaatttatagattcaatgccatccccatcaagctaccaatgactttcttcacagaattggaaaaaactactttaaagttcatatggaaccaaaaaagagcccgcattgccaagtcaatcctaagccaaaagaacaaagctggaggcatcatgctacctgacttcaaactatcctacaaggctacagtaaccaaaacagcatggtactggtaccaaaacagagatacagaccaatggaacagaacagagccctcagaaataatgccacatatctacaactatctgatctttgacaaacctgacaaaaacaagcaatggggaaaggattccctatttaataaatggtgctgggaaaactggctagctatatgtagaaagctgaaattggatcccttccttacaccttagacaaaaattaattcaagatggattaaagacttacatgcccacttttaatagtgttgtttgctttcttcttgtaaaaataagttctttatagatatttgatattagacctttgtcagatgcatagtttgcaaaaattttctcccattctataggttgtctgttcactctgttgatagtttcttttgctgtgcagaagctctttagtttaatcagataccgtttgtcaatttttgcttttgttgtaattgcttttggcatcttcgtcataaaatatttgcctgttcctatgttcagaatggtattgcctatgttgtcttccagggtttttacagttttgggttttacaaataaaaaagaaaagagagataatccaaataaacacaattggaaatgacaaggggggtattaccactgacaccacagaaatgcaaataaccatcagagaatattatgaacacctgtatgcacataaagtagaaaatttagaagaaatggataaactcttgcacacatacaccctcccaagactgaaggaagaaattaaatcccttagcagaccaataatgagctctgaaattgaatgagtaataactagcctaccaaccaaaaaaatcccaggaccagatggattcatggctgaattccaccagaggtacaaagaagaactggtaccattcctgctgaaactattacaaaaaattgaggaggagggactcctctttaactcattctaggaggccagcatcatcctgataccaaaacctgacagagacacaacaaataaagaaaacttcaggtcaatatctttgatgaacatcgatgcagaaatcttcaacaaaatactagcaaaccaaacccagaagcacattaaaaagcttatccatcatgatcaagtaggctttatccctgggatgcaaggttgcttcaatgtacacaaatcgatagatgtgatttatcacataaatagaactaaagacaaaaaccacatgattatctcaatagatgcagaaaagacttttgataaaattcaacatcccttcattttaagaactgtcaataaactaggtaatgaaggaacatacctcaaaataatgagtcatctataacaaacccacagccaacatcatactgaatgggcaaaagctggaagcattccctttgaaaaccggcacaagacaaagataccctctctcaccactcacattcaacatagcattggaagtcctggacagagcaatcagtcaagagaaagaaataaagggcatccaaataggaagtgaggaagtcaaattatccctgtttgcagatgacatgatcctatatctagaaaaccccatagtttcggcccagaagctccttaagctgataaacaacttcagcaaagtcttaggatacaaaatcaatttgcaaaaatcactagcatttctatacaccaacagtcaggcctagagccaaataaggaatgcagttccattcacaattcacacatacagacacacacacacaatacataggaatactgctaaccagggaggtaaaaggtctctacaaggaaaactacaaaacactactcaaagaaatcagagatgacacaaacaaatggaaaaacattccattttcatggatagaaagaattagttaatgtggccatactgcctaaagcaatttatagattcagtgcttttcctatgaaactaccaatgacaatgacatttttcataaaactagaaaaaaaaactattttaaaattcatatggaagcaagaaagagcccgaatagcaaagcaatcctaagcaaaaagaacaaagctataggcattacccaacttcaaactatactacagcgctacagtaaccaaaacagcatggcactggtacagtaacagacatgtagaccaatggaacagaatagagaatctagaaataaggctgcaacctacaactatctgaacttcgacaaagctgacaaaaacaggcaataaggaaatgactccctattcaataaatggtgctgggataactggctagccatacacagatgattgaaactagaccctcttccttacaccatatacgaaaattaattcaggatggattaaagatttaaatgtaaaacccaaagtgatagaaaccctggaagttcttatgttttcttgtcttagttctcagctaaaggacccactcagtcctcaattagtgtctcatgggaaagcttcagtgagacttgtcagcctctccttttacacagcttctgcctctctaataccccatcctgagaattccaatcacttcagtggtgctgtagtataatctgcctgttcatctcagcaagcccattttctgcacagggcttccacctgtgtggtttgaaaagtgacctcaggtggaaagcctgatcactcacacgggtggaaaaatatcaaaagtgcattttaaatgagtatactttaatggctaaaggctaataaaatgcaaacctccagtaaaatatataatggtctcaccattgcaaaacaggctaagttttaggtttgatgaactgctttcactctcttggtgttgtcatagcatcataagtcacagatagaggaaatgtaatacaggtactatgacaatgataaaataacttaatacagatgtttttgtaaaaaaatgttaggctggaaccagaaaacagaaacacaaggaaatgtaagaaaaaatattagagatattcgaaggtgaataatctttgtgcgtagttttccatcaaattacccaactcagctcctgattagctgtttccctagtacttcagtgaaaagttaattgaaaactagaatatactaatacttaattttaaaaaatcttttttatcacctttgagtgatcagaaatactatgagaacttctacaagttttacagtttgcatttgtaaccgttgtcacaaatggttaacagcacaaaaaagtgctttttattttatttttcttttaaatgatagaaaacattacaacaacagggtgtacattcattaaagtttaaaaacacaggaaattgtagacactaatgcctcctttatttcttcttccttttggatcttcttttcaattgttggtttctgcaaagtacatcaaataaaaaaaaaaacctagtaagaacatgtaagtattcattagctatctggaggagtaaatacaaaggaatgttttctatgaatacaaattaggaaatgttacttttgttttctttgcttcactgtgaggaacccacaccactgaacacattttaaatgctacttatcttcatgtatcagccccaaactaaaaattttaaaaaatccaatctgactgacagatattagtaataatagatttactttgattttaacttcatgttaaaaaatatatcctttacttgatgccttctttacttagtactccatgttaaaacaggaattgtgcaagcactttcagtggatacagagttacattgtgcttttattatacttggtatggtttctgcatttataaccaaaaccattgttagtatttccatgcgttgtatcatctaatgtgctcagtcttcttcctcttccattactcatattttgcagctgtttttagttatttcagaagaaatctaccatcaactatgccttgcctgggaagcttaagagcacaacctttatcatcaaatccctaatctactagttggccttcggctattcatgttacatcattgaatctcagtttcatgtctataaaatggtggataataactgtcatctctggggattatgtaaggattcaatagataatggatacttatataaaacattcaaaacgaggtatagcacatgatgagattacaagtaacagtagctactttctctgtcataaacatctaaaagattgttgaagctcttcaccataccatatggtctacatccgtaataacattgagaaataggtagttttcacctctaataggcttaatcatccatttttcacataatgtaatctgatgtggtcatcaatatataagaaggtattctttcaaatttttggtatcaacagaagcaagacttaaatttccaacttgtgattcaacaatttaatgttttatttttaaaagatgcattgacagataaaattgtaatccactgtatagcatttcataacactattttgaataagacagccaggatattcagatctttactagtccaaaccagataaactataattttcaaatggaattcttttcactgctattgatttacattgttataaagccagcaggtaaaaatcatgtttgccttaccaaggtaaaccaaaattatgactgcagttatcttcaggaataattatattggacattatacttgaatttcttcctttatataataaatttagatagtaccaaaaataattgaccaactggattcactatatcataaaattgggtctcattttctttcatattcaataaagtatttatttttatttaacaaacaatatgtcataaagttttgaataaactgctcttctatgtgttattgtgtgtatacaatgagtatgatgtggtctctacatgcaaagaagcatgcaaatccataggggaaatagacacacttgataatgcatagaaattaatgaatgggtcagggaaacaaattgacttctatctccaagataggctacttttcactatacccaataaataaccccctcgattactgaggttatcttcataaagatgctacatactatctttctgttttggtctgtattttatcccttgccccattcttaatgagcaatcaatgttatttcaagataagtaatctgttaaaaaatgtgagtagtagaatccatgtacttctcaaactaagtggatggatgtgatttctctcaggtacaacacattttgactttttctgctgcctttgctttcttttctgacacataagatgcatattttagatcaaataaattcatttttctctagaaagagctcataattaaaactaagtttaaacaaagcataatgacctaactctaaaattctatatttctttgccggtagaaacttctctctcaatgataaaatccaaaacagcctgtgataataccatgaaatccagtaaaagggacccagaagaacttaagctttaaaaaaagaatatccgtgtgtcttatcatacacattacatttgaaaaaaacacatatatgcttaatggtgaagataagattctctcctctcaaagaccaagaaattatgcagtcatattctgtctctgtgcagatagctttccgtttgtttaagaacaatgttacccataaattctccagctttattccgtagcttgaagagcctacgctgataaatttaagttgggcactccatttttctcagaaataattcttgcatttagggtgactccttcgaacttgctttattagatggggttctccatcttcttttgtaccaagaaagggagaactttctatgtgtatatatacaaatattttaacataatttttctcacactttgaagcagatatcagataatcagataccaagttagtgcagtttgctaatattatattttttttaagtaacaaagcaatcataatctgtgttgcatttgtttggtctttcttctccaaattgctcactcaggtaggagcagctgttagttagtggtaagtcaagaatttagggattctctacaaggaggagctggtaccattccttctgaaactattccaatcaatagaaaaagagggaatcctcactaactcattttatgaggccagcatcatcctgataccaaagcctggcagagacacaacaaaaaagagaattttagaccaatatccctgatgaacgtcaatgcaaaaatcctcaataaaatactggcaaaccgaatccagaagcaaatcaaaaaacttatccaccatgatcaagtgggcttcatccctgggatgcaaggctggttcaacatatgcaaatcaataaacgtaatccagcatataacagaaccaaagacaaaaagcacattattttctcaatagattcagaaaaggccttcaacaaaattcaacagcgcttcatgctaaaaactctcaataaattgggtactgatggggcgtatctcaaaataataagagctatttatgacaaacccacagccaatataatactgaatgggcaaaaactggaagcattcctggcacaagacagggatgccctctctcactgctcctattcaacatagtgttggaagttctggccagggcaatcaggcaggagaaagaaataaagggtattcaccaatggaacagaacagacccctcagaaataatgccacatatctacaactatctgatctttgacaaacctgacaaaaacaagaaatggggaaaggattgcctatttaatgaatggtgctgggaaaactggctagccatatggagaaagctgaaactggatcccttccttacacattatacaaaaattaattcaagatggattaaagacttaaatgttagacctaaaaccataaaaatcctagaagaaaacttaggcaataccattcatgacataggcatgggcaaggacttcatgtctaaaacatcaaaagcaatggcaacaaaagccaaaattgacaaatgggatctaattaaactaaagagcttctgcacagcaaaagaaactaccatcagagtgaacaggcaacctacagaatgagagaaaatttttgcaatctactcatctgacaaagggctaatatccagaatctacaatgaactccaacaaatttacaagaaaaaaacaaacaaccccatcaaaaagtgggcaaaggatacgaacagacacttctcaaaagaagacatttatgcagccaaaagacacatgaaaaaatgctcatcatcactggccatcagagaaatgcatatcaaaaccacatctcataccagttagaatggtgatcattaaaaagtcaggaaaccacaggtgctggagaggatgtggagaaataggaacacttgtacactgttggtgggactgtaaactagttcaacctttgtggaagtcagtgtgatgattcttcaaggatctagaactagaagtaccatttgacccagccatcccattactgggtatatacccaaaggattataaatcatgctgctataaagacacatgcacacgtatgtttatagaggcactattcacaatagcaaagacttggaaccaacccaaatgtccatcaatgatagactggattaagaaaatgtggcacatatacaccatggaatactatgcagtcataaaaaaggatgggttcatgtcctttgtaaggacatggatgaagctggaaaccatcattctcagcaaactatcacaaggacagaaaaccaaacactgcatgttctcactcataggtgggaattgaacaatgagaacacttgaacacaggaaggagaacatcacacatcggggcctgttgtggggtggggggagcagggggggatagcattaggagatataactaatgtaaaggacgagttatgggtgcagcacaccaacatgacacatgtatacatatgtaacaaacctacagattgggcacatgtaccccagaacttaaagtattataataataaaaaagaatttagggattctggattctggctgaatgtgatccacagactgaagaagctctttaaaatcagggattgtttatcatgatctctttagtattgagcaaagtactctgtctagaaagacatttataaatgctttaaaacctggctgattaagaactccatacttcctggtaataaacaaatctcgttttcccataattcccatgttgtgatattagagactcataagcgtagatctagttctctttagagaccctgtggtgaaaactcaaaagttcaggactgaataaccccacagagaaggctgaatcctaagaatatcagggtcagcaaagcagttgactcaagacaggctgacttgacgatgcataaaaagattttgtcctccaaatcgtgactcttaattcccaataaatgtaattttgatttgggattcagaaggtgctgtaccaaggtatgcccaagagttttggaagtaactagtggcaaaatgaaagcttgtctatccaatccctttctgcaaaaattttagatttctgtggaattttcaagccacatggacttcactggggataatgaaacagcagtgctcatatttaagcatagctgtgaaaaatgcttgaggggcatgttgcagtgtcaagttttagaggttgggtcaattgagggtctgtccttgctctgtctcttgctacttgttactgtttttgcacctgtaaaatggtgtgagaatgcgtgtctcatgaaactgttgtgaggatataagggaatacatttcacaatggtctccaggtgcagagggagtaaggataatgtcatttatgccttctgaccatggggcatattttaaaagaatatacacagagtaggaagttcttactcaatttttttctctgtagataaaaaagaagaaaaaaacctctttgtctggaaattatcttaaaagccatatttcttttttttttttttgcactgtcaatggaaatagaaactaggtggcctaatgtgacattctgtcactgaaatcatatagaaagcataaagcttgctctactgaagaaatttagagagattaagatgccacctccctccttgtgatacttgcttatgagagtgttgttctagagcatttgatttccaaatatggtctcttgaaacctgcctcaggatcatctgaggtgtttgttaaaaatgtagactcagggtctaatcccaaatggactaaattgaaacatccaatacggggccccagaacctgcattttaaacacacccccagatgatacatatgtaatctgaagctgaagaatctcaacctagtgcagcaatctccaaatatttgaccagccaccaatttgtaaaggttttgatatcctccacgtatgtggtgtatattcaattaccaattgtaaacattgtcatgaataaaattttagaaatctagtaaaggttagaaatataaatatgattacaaattaaacattttatttcttcctttataatggtcttataaacagtctgggatgtatctctggtccaaatgttacctttacctcaaatgtggagaatagcatgctttagagatgggacataaaaatctatctctgtgtattatatattttttaaaaaatttctactgtaaaatataatgtaactcttggcttccattcaaatgtgacaagtcttagcattttgccaagtttacttgaaaatttttaaaaaataaaaaactatagaaacatttaaaatcctctgtgtattccttcctgtcccttgtcccatccttttaactccagagtaacaattattctgaaatgtcagtgttatggctgtcattcatggctttatactatatctacataggtatttatccacaaacagttctctttctccttccctttttctccaagagaattgttatatgtgataatatctttatgtaagtgcttgcttattttgcttagtataatggtctttaaatttatctgtattggtacatacagatacatatacataaaataaatgctagtttattttagctattataatatttcattgcatgaaaacgtgtatttgtgcacatgtgagaaagcttttcttgagttatatgcaaaactggaattcttagcttgcacatttagtagatctacaatttttatttttggatgtcttatgtcagatataaaagtgtacaaaatatatcttgctttaaattttattggtcatgatcagcaggatagcacatactttcatgtttgtgacccttttttttacattttccattaactctcattttctttgttcatttattttttctgttgggttctttgacattttcttattcatttgcagatgtttttgtatattttggatacgaaccttttacttgtttataggtattgaaaatacattctcctaatgtgtagcttgcctttcacttttgcttttttttgcacaaaaaatttaaattttaatcgaattaaatttataattattttcttttagatttgttgagtcatcaaaaccgcaacgtcatgttttctcttatacttcctttttctaagtttaactttgattttcagatgtagttctttggttcatctgcattttttgaaaagtgtattttttaatttacatgaagtaaaattcttttttgtttttatttttggctaaacttttgtgtgagctttgacagatgaatggacttgtgtaaccattgccacaatcaggatgcagaacagttccatcactccaagaacccctttgtgttgtccctatacaaactctccatctactcccaaacactagcagccactgatctgttctctacccctgtaggttttgtctttttctgttctctacccccgtaggttttgtctttttctgttctctacccctgtaggttttgtctttttcagaaagtcatagaaattgaatatacaatatgtaatctttgagtccagtttttttcacgattaagatttaatcatgttggttcatgtatcaataatttgttctttttcttgctgaatactattccattgtatggatgtagcacagtttgtttatccagtaagctactgtaagatatttaggttttcagttctggtgattatgaatatgctgctatagatattcttgaacaggttttcgtgtgagcatacattttcatttctccaaggcaaataccaaagattaagtgcatattttaccttataagaatctgtcaagctgttttccagagtgactgttagcattttgcaatgtatgaggattccagttactctgcatccttgtcagcagtcaatattatcttttatttattattttttagccattctaactattatctcatctgtacctcattctggtcttaatttgcattttcctcatgataaatgatttcaaacttcttttcacgtgcttgtttgccatcacatatgttctttggggaactatgtattcaaatcttttgctcattctagagggggtttttttcttattattgaatttcaagggacagggttatgatatttagtctagctctccttgtaagaactggaagaggaatagttgtcattagctatcacattctgtcttgggcacatagcagcatcaagacatcctaacaattcatacaaatgcttaatagtgttaactgttatgtcagtgttaattgtggttaaatggggggagttctctactctcggtaataaaattatcttttcactccccattgtcaccaaagcataaaaaaagttccttatatattccatatataagctgctcattggatatatggtttgtaaatattctttcccagtctacagtttgttactttttttttttttttgaaacagagtcttgctctgtcgcccaggctggagtgcagtggcacgtacagttctttacttttaaagaatcctggccagttattttgtagactgatcttcatttcaggttgtctgatgtttctatgattaagttcagattatgcattttgggccagaataccacagaaatgaccttaatctttggttgtctctgtgcttcatgtcaggtgatacatgatgtagatatgtcttattgttgtgatgctttcattttttacataggggtttgagttatcagattataatattagtacattaaagtctattattataacagtggtcttgtcagtttcttcttgaattctaccagttattgaggtaggaatttttaggctttaaaaaataacatgatattgtgaatagtgccgcaataaacatacgtgtgcatgtgtctttatagcagcatgatttataatcctttgggtatatactcagtaatgggattgctgggtcaaatggtatttcttggaaccaagccaaatgaccaacaatgatagactggattaagaaaatgtggcacatatacaccatggaatactatgtagccataaaaaatgatgagttcatgtcctttgtagggacatggatgaagctggaagccatcattctcagcaaactatcacaaggacaaaaaaccaaacaccgcatgttctcactcataggtgggaactgaacaatgagaacacacggacacaggaaagggaacatcacacaccagggactgttgtggggtggggggaggggggagggatagcattaggagatatacctaatgttaaatgatgagttaatgggtgtagcacaccaacatggcacatgtatacatatgtaactaacctgcacgttgtgcacatgtaccctaaaacttaaagtataattaaaaaaaaataacatggtaattaacatcttctgtgtttattccttagtcttgtgtgttacttccttctttgttgctatgatggtttttggctttaaattctatttggtctgatagtaatattggtaattttccccacttaccccttcctttttagtcttttaaatggtttttagctcaattttggtgccttgcaaatattttagactttcatttttaaaagatgcacttatattttattgtaaatattaacacatttagaatcattgctaccactttattttgtaatattttctaagtattcattttcttttcttttctttcttctttagaaaaaaattcttttttatttcttgtgcaggtttacaggatttctgttcaatttctacttggggcaaggtttcccttaattgtttttacatgagtaattaaatatttttctaacaaggcctacattgatttagtgtttctctcttaatcacaaacacaccacaaagatcctagtaaagtttaactttcctttgaacagctcacccaattccatgtgcacacatgcatacattcatattgttattgctatttagaataatagttttattattaaaaataataaactattgcatttaaaaatcaatagttaaatatagtttgaagcatgcatttattaatttatctgttcactgttgtttttacttgtcttttcttcagggcaccattttcttttattatatataacctttaatagctccaaattggtgtttctcagcacactggatggttaaatattgatctcctaaggcctaaaggtgaaccagtgatttttaggtgaccaagtgcttccacctgagcatagccttgtttgttcactcccattatgattttctaagtatgtcatgattttaaaatgtttggtaaatgtcactccaacagcctttcactctgagtctggagcttaaactctcatctttgaatatctgaacagctttttattacctggatttaaaatttgaggttgacagtttttcttcagcattttagtattactttattctatatattgcttctaatgggacatatcttgtcagattaatcctcattcttttgttcataatccttttttccctatgatagcttttgtggttatctctttatccttaatgcttttacatttcacaatgatgcaattaggtgtctgtttattttcatttatcttgctaaaacactttgaatttcagaagtagtgtctcctttctacttggtaaaattctcactcatttcatctttacattttgtgtctccatcacttttaaaaaatctgaactctgatgctagaactcctctattctctatgtctcttaactgttttggttcctgtttaaatcactttatgactctatgctgcattatgggtgaagacttcagtactattattcacttaatctcttctcatctgtcggctactgtgtccaggctagattttattatatcttttaagatttttttctcccacaatggctacatttttatagccaaaatttatatttgcctgtttatttttatattgtgatggttagaatcctaaggtcgtttctgtgatccatgtccatgttggtagatatgcttcttcttttgaatgtaggtgggacctgtaacttgcttctaaccaattcagtttgacagaagcgatggaatattattcccatgattatgttttgctatacagcaaaactgaagagaatttgcagatgtagtcaaagtttttaatctattgactttaatctaaagggagattatcctggatgggcctgtcctaaccaatcaaaccattttaaagagggtccagaggtcatagatgggggcagtggagttgctcttttctgggccttgaagaaacaagttgccatgatttccacagctacaaagaaatacattttgccaacaaccatgtgtgctgtggagaggcccccaaacctccagtgagaccacaccccggctaacactttgattacaatgtgggagacccttagtagaggagacagataacactgcaactggcctcctggaccacagcaactttgagataataaatgtatggtgtgtttagtcactaggtttgtggtaatctgttatccagaaaactaatacatatttgtatcaatttttgtttcatggtttgctgttttaatttcagtatttcctgttcttttcttgaatattatttttatttctttagttattttattattaattaaactttatacctcttttctattgtttttatttcattttatctgcattggattttgaattaattttgttagctgtctaagaactacattttttgttcatgtaattttcgggtttaggctcatttaaataggaaacgctctcccttttaccccttcccaccaccttcttcatctaaatctctattcccacattacctgttgctttgaactgcctcccagaggcctgctgtttcagaaagagactttgtatcagctgcaccatggtgattagtcctgaagccagctggtatatttctttaggtcctgtcatggagatatttttgtcttgtcctcccacctccttaggtaacattcatagaatatctaacccaggaagcagacattttttcagatttcttttaaaatagggagcttcatcataccagccactggtttcaatcagttagcctggtctccctggtaacataagacactttgctatttgttgttcctcagactcttccagccccaagtctatttctgaatcagaagctcatctggtttgcagcttcagctctgctcactcctctattccattttgggatctcaggtgtatttaccttaatttgaagcctagttgtgtttttttctcttttaattgaaaatatttattatcatccatttatggagggaaggacagaatttaaacttataattcttatttactttgctgaaaactataaaaaggctcataaccatattattttattagatatatttaataatgaactatatttaataatgaatgcaatattcacaccaacattcatgtattgacatgtacttatctaatctttttggatacttataacatttttgcttattttctgagtattatatcttagtcatgggtccctgacatcaactttatacactgattcctttcaatggccagagttggctggattaatggtttaacctgggtaaaacaaaggtttttcctgagaatttgaaattgagagaaaaagaagaaaatagagagtactcagttgcttttcctgtggcttacctatgttaagctaatcatgccaagtttaccttcaatgaaagaaaaagtagaaggtagttgttgtttttttttttcagaaagacaggagataacctgaatagaaacaaaggttagagatggatagagggctttataattccataataatctttcctatatgtgtgttttaagagatacctacagatcctttacaataaatttatctagttggtgttactttattgagtttctatttcttgcaagtaaaatgagtcctaactaactgtgaggggtctgcctgtcattcacttggctaagctggacctatgctttccagaatacccttccctaatgctctaggctagagttggctaaaagtggtacttgcatgacatttgtttagaagaaggaaaccagcatccattgctctccaaaggttgtgatgacagtcgtgtgatgagatctgaggctgtggtggcagactgagtgaggataaactgatgggttatagcttgttctttaaaatctcctctgctccacatccagcaatcttgccagctgctgatcttgctgaccaataaaggcctcttgtccatcaccaggtacttggaggcagacccctagacttcttccagagacttctccatcacctcccattactcagatccatgtacatgtctgaacatgaaatcagtggtttctcagactgactgatctctgactcctctagcttcccaatttttcctttcagacattcattaaggaagatctaattcctacagcaaatctctcatcccatagttcataatcattttgcttccctgactgaatccacattagtgatacactaatgtaacttgtcatgttaaagcattccttaggagtatgatttccagccaatttcctcaatacgcttctctgctgaaagactagctcccatgtcttctaaattgctccactgcaaagttttctgtgccaataaagattttttcttcacaaatattgttaaattattatatacaacataacctttgaaattaaaatctatggattttttgcatactgtttattgagcaactactacatgctaagcaaagctctcaaactggggatgtaatagtaaataagattaaaatgcttctgattttatagatttttgcattctaattggagaagggaatacaaacaggcaaaaaggaaacaaataaataagataatttcaaatagtgcttatattatgaaggaaatgggcagggagatctgagagagaataactagcagtgatagcttctttagaccaagaagtcaaagaagcactcttagaagttgtcattcgaacagaaacaaatgacatggaggaccacctccatagagatcttgggagaaaacattccaggaagatggaaacagttaggtgcaaaggcctaagaggagaaagaacttagcaagttctaaagaagggagaagagtggcagaagatgaggtctgagaggtaggtatgggttaaataatgtatggccttgtaggctacagaaaagagtctgaacttttttctaagtgcaaggaaataccagtgctgaatttagctttgttatatgttttctgttttaaacttccctctgatgactgggtgaggatggatggtaaggagacaagattggaaacagagactagtacaaggagcatggagaagaggcaagactcagagttggaattatgtagcaccttttttctctcatgtcccttcattgtttatttcaggaagggaagttcttccctcacgttcattgaaaatgtgagccattctatgtcttttctgagtaattttagataaattttattcacttaaaattatttccaaagttagaatgtgcattcacgtagaataatcgacacttagttttcattcaaagctcaagcctgttgcaggtgcaaagcctacatctgggcagggattgtggttggcttctttccacctcctactctgtggtttctgtttcctggtaagggagatagagggacaaatgaaagctaaggggaactgaggcaggaaggctctgacttgtctggtacctcaattccctctatgcctagctgatatttagaactcatgctttcctttctggagtacttttatgattaatcagaaaccctacctacacccccagtcacctgaaatcttactgatgagtgatgctctctctgtctcttcattaactacttctagttaatgaaggaccaccttttggatggtcctatggggcatgatatatgtgaacctcacaactcttggagtatgtggacaaaatctgataaatgaggaacatttaggcatcattacactgaagaattctaggagaacattcagaaggatttagtcacgtctttttttactgcttctttcagagcagatagctcctcatatattcacttttgaattttccaggaaggagtcagataccagtttattatatttcccacgctgcaggggctctttgctcctcactgacacaaaccagtcttcccagatatatgtctcatgccatcaaatatcccacctgctataaccccttctgcagtctaacacaacacatgagtcattcctcacttgttctgtgaaacatagcatagtggtttaaaaatataattagggatacagacagcttgggatcaaatatgagttcaacctgttagctgtgtgactttcagtaaagtattgaagtcgtttgcaccccaatttcttagactgaaaaatgatgataataataagaataccttacagagttgtgagaggtttaaaagagtcattatttgcatagattagtgtctgggtcattgtaagcactcaatagctgttgcctgttactccctgaagcttttcattcctagaacactgtctccctttcagcctgtccaacactactgtgctcttagttcctgatgatttgaataccttggcatctctcttctttagtaacctcttcttcaagggagtggtataccaccttacctcagaaattctctcacttattccctcatttcatcattataacagttgtaaaccttccatcatctcacttttaaatgatctaattctctgtctgcaaccttctattttccctctggtatctcaacttcaataatccctcaacccaggcagaacccataatccattgatcttaccatatttgcactatctctcagccctgtcatgttctcaagttaccttgtacatattctaaatttcataatggaacagtagactcaatactttacccataatccttaactttcatgatcttcttgctttatttgtacatacttggcaatagcccagtcatggcctaatccactccttccttggtcagctcctgcaggtgtggagtgtgttgcacatagacgaagacatcctgccatactaagttgtctcatatcaaatccatgaaaactaatttcaaatggggtccaattggtttccatcaaattctataaccttcccccaattatttgcttttctatccactggaagaaaatttcataccttctcaaccaccctcaaacttcttcctctgcctacgtctcaactgatgatttaataggaaaagggaagtaattagaagagattggacacaagctctcttgactgtgtttacccacttagcagcatgtgtacatacatatgctttcttttctcctcttattgaaggtgtactaaacatgctgctacacaggaaaaagctccaccgtccccactccttcctgcccatgtgcacctgtcccatttcctttcattgactcagttatcttctctcactcctgcaataccaggttttcctatctactgaatcatgctcattagcatcagatatacttatatatctcaatcgattaaaaaaattcttggctgggtgcagtggctcatgcctgtaatttcagcactgtgggaggccgagtcaggtggatcacttgaggtcaggagttcgtgaccagcctggccaacatggtgaaaccccatctctactaaaaatacaaaaattagccaagcatggtggcacatgcctgtagtcccagctcctcaggaggctgaggcaggagaattgcttgaacatgggagacagaggttgcagtgagcagagatcatgccactgcactccagcctgggtgacagagcaagactctgtcaaaaaaaaaaaaaaaaagaattctcctaacttctcctgaccttcagatttcctccttataatgccctctttttagcagaactcctcggaagagttttataactgctgagtccagttattgttggtcagtctcttgattcactgaagctgattattgcttcacccttaatgacacttagactcatgatttaaaattccacctacctttggcaactcccaagattaaagttttaacatgtctactagatattgaacagaggtatttagcatattctcagtcgctgtacttcaccttcccaactcccactattctcttcaatctttcccaattcactaataccatccttcccattactcaggccaaaaatccttaggctcatgcttgacttctttctttctcacacactgtgtatccaattagtgaaacctattaggcctacctagtaaatatatcctgaatccaaatgcatttaaccacctccgttgttttcatcctggcccacgccaccattatctctgacctggaattttgcaatagcttcctgttgcaaacctgactgcttctccccagaaatattgctgtcaattcagaacacagcagttgaagtcatcctcataaacccctatggcatgaagactaatttgaggggaattctttttaacaaaatagaactaaaatctttaacatagaagatggaagtaagtggcaggaattaaagcattctaagtttattctatttgataacaactaattaaatccatgcattgcatttggagaattatgggaggaggggttttctatgccatgaagcaatgttccgtgaagctaattctctggtataaattttcaataaacctgatgaaagtgctatatgctaattagtcttaaaatggaaagaacatttttaaacttaattaacactatgttattttttgtggcctgttgacagagaccaagttgtgtgggaaacttcctttaagaaaggtacacttactatatatgttaactgtggacttccacattgtgaaagagaggtctactggaaatagaattttcctctaataagaaaatattgttagtgcagaaagaaggtaaatttagattggctaggctcagaggaaacaaagtaggcattcttttcatataagtacatgaagaatcctttcataaagttatagttgctagtcttcttagtcacatggtaagtacttaatgatatccattttcgctatgttggagatagaaatgttgcgttaaatatgtgaaagcaagctggaaaatatttaattagtgatggtattattacctatggagaggaatgtttccatcctatcactggtgggacacttggaatcacctgtttcctgaacctcattttcatgttcaatagctcaaatattctggtaatcccatgcccactttgtgaacttgagcttcggaagggaggcagatagaatgtgaaacaaatgtaggcacagccacgctactcaagagaaaagactcctgtgaatcctgtctcttctgagtctccttagtttttctgcctcttctctgatgcccagctttcttggtagcttaggtggaaatttacttatgaaacatccctaaatagaaaggttaagagccttgattttccccaacagtaatatagagcatcctcatatttacagtaaaattcttcagttcatttaattacttgcatcattcatgtggggcttttgtttggttgattattccttagatctttcagtatgcaatgcttatacagaactttcatttaaaaaaatgcaaatatgagggaataagactgtatccataagtcatatgcctacaggaaacttattcttcagtggtgtaccttaagtggaagtctccattagttaaatgctcctaatccataatcccctattaagaaagaggcttgttttactttgttttcaattttcagttattataaatactataataataaaaaatttcccctcaaaactttcagtttggtttaaatgcttgatcttgctaagttttgacaggttgcaaattgtttaattcaggtgcttcaattcctgttagttggattgacataagagcagaagccagattctcttctctttgctgacatggccacatagatgatagggcctagttttgcactcatctgttaaactccattaataatatattagttgacagttttacaagctgaccaactcagtgttttatttcattgctactatactaactatacaaaggaatgcattgaataaaagtgatgacactttgaaaggcaaccactatttcaaaaataatcattggaatatatacagactctgtggaagagttgagagattatgcccctatgctaatatttgttcacatcattttttactgcatgtgtggtaattgtcaccttgaatcacaagaaaatgcagaggttaggaaatggtattcttgcaaatttcctctggacaatttttaatgaacaggcatataaatattttgttttcttgaggaagaagagaaaatgtccaatttacataatctcaatttctttgctatctactccactgaaatatctttatgtttttgcatgatttgctacatagattaaagtaaaatcactaggagaagcaaagtatatattgtaatagaatgaacaaatatagccgtgaacactgggcaaggactcttggcagctcttccctgaaagctgtggaggacctgctgtgcggagccctaaggcattctgacagtgaaaaagcacactgataaataatgttttaaaacatttaattaataactaaggccacagtatgtatcccttgtaactcagacaagagaggtttttttttttttttttcttctttactctgcagtattagctactttccgaagaggtaatatgcaaaagatatgaggaaatgccaatgtctttttaattagtgtttttgactataaaaactttataagcattccaaaatgaattatggggagatagaatggcaactcaataataataacagcaacaacatgataccattgcatggaaatactatagagtgttaaaagcgcaggctctagagttatacaggtttggagcggaaacctaactttgccagtgtaaactccctgcatcttctatgtaaaatagggatataataggacctatgcacagtgctcttagggctaacatagataatatatgtaaaatacttagtgcttggcacataacactcagtatgtcttagctattcattatgagtactgatattttacacaatgctccatcttgaagaagagagtgacagagtatgttgagcattaatgcaagtattatttcaggctataagccattagatggtctttggtgcagaaaacccacaggcccctttggatctggtatccatagaaggacatacacaagactcatgatccccatattctttcatggtttcctcatggatccctttgaccttgtttaaaaaaaaatgtgagatgccttatgaattccacctcaagccacaaaaccaaatgttctaaagtcctgctcatactacaaacatgcctgcgaattccacgctggggttgtccttcttatttctttcagatgatgatttattttcacctattcccttgttctttccaggataggttaatgtggacttgtaaatccagtcaccttcctcaaagaagccttttctgaccaccacagtctaagctgatgtccctcccatgtactcccaaagcatcctgtgtttcttctgtctcagctccctgccctgtgacaattactctgttttcttgttttgctttcccttccagcctataagctctaacaagacaggcagcattgtgtgcctgctgcccaccacaatgtgtggtatattgtaggtgcttaataatttttatgtggttgttgttcatgattgagagagtgagctagctgtgcaagtagttatattccaatgcctgtgtccttaaggatatgtattctcctctgatagaaatacaggtgtaagggatatgaagtgaaaatttacatgtaatagtaatagtaaaataaataaattagatgggatacggaccctatccactattatccccttttaattttcacaaagactaaattttgccatttgttcaggagataaaaaaatgtatgaaaatgtgggccttgttcacacaccctctttgacttattcatttatttaattatgttgtgcacttggaaaatgactaagttatctatttcacataaggtaatatagttataaaaggattagaatgttcacatagtaaaataaccagaagtaaatctgtgcactgttttatattttacagagcactttcatactattgtttcataataataagtcttaatatgcactcaatctcattttccccttagattgcctattgttagcccaatgaatttggaaaatgacttccagatccagaaatttacctaaccttcccttacaaccttgactctaattcttttgtttctaaccaaaaaacagctcaaagctctgtattatgttgtacccatttgactccagctactttccatttggtggcaacaagttttttgttgttgttgttgttttgtttgttttgttttttttaatgtaagcttcagtcacatagctgaacataccctcacgtcttttctatcttactaattatcagtcttcaaatgattttccccttctttaatcctctactaatttggcaagaatggcttggtaccatctaggtttttcaccctatttcaatatacttgcattgtgattggaaggctaatttgttcaggacttgtacaatgatgagcttttctcaaaacagaagcagcaagctgcttcacaccaacgtatacttggcccctctcctgtcaatccatatgtagcagatgcagatagaatctgttggttggcacaagaagctctgttgcacatggctcctatttttaagcctctgttggtatccatgtgcggagaacacggcttgttactgatggactctgaatcactccacaaggaaccaaattcagaaatccatgcaagcagcctaaaaatgaagaactgcttagtgtgtatgtgtgtgtgcctgtgtgtatgaatatatattgaccaggaaaacatgaataattcagccccctcatacctagccactaagatcacagcactctaaatagaattgcaatgattctatataaatcgtatcagtcttgaaaggtccaatgattttactgacagattttctctcactccccacctttttaaacagtactattacagaggcacagatatatgaattaatggctctttgattttaaataattgttgcaaaaggccataagggtggcttgctgtagtatgtcattttatggagaataaaggcccaaaagataatttcaaaaacatgttatgtcctgtcattaatgataaaagtgcattaattgatttggctgtcatcaagagagaagtttgatatgagattttcaaattggttcctagacagtgagaatcaagtgattacttgattttttgttaggggttctagtaattccttactataaattattttttatcacatgagatacctttcaaagtacactaaaattctaacgagaatttctggtagagaaaagactgttattcaaaaaatgtttcttttgcttaatgtttttcttcccatacctgagctgacactttgttcttttatctttatctcattcttatctgttacaatatacacataccttgtatgtccgcctcctactatcctgtaatagctgaatatattaaggaagacctaaggtaattcaggccagtgagggatatgatgaaatagaatgattattttgggataaggggctcaagaaaggctagagagtggctaacacaataaagagaagctttttttatcatatagatatgccacatcaaaaaaaggtgtattttagtgtccccaaaacctgctgtaagtataatctcagacacaatcttgtctcggactttgatttaagtttataacttagttttggaaaatactgccccatacactttattgtgggtgtctgtcaacaaccaatcccatcccaagaccaatgacacccagatggaatttatcctctgggtaaaatttgtttattatatatacaaaatagaataaaatataaaataccagcatgtatatacaaaataatggacagtattagttttgtgaaacatttgttttggttatagtttgtgtgtgtgtgtgtgtgtgtgtgtgtgtgtgagtgtgtgactggattatgattcagtggctcacccatttttcctttcaaaaaagtttgaaccttgctacccacaaccttgctacttctctgacctcccagtcccccaaacaccctaagcttcaccaactgtagacaaatgactagttaagtagggtcttttgagatcacctccactacactaggaattggtaagaagaatattcctgcttcaggacatctgagggagagagagatattgatggcatgctcttttctcaggccatgcatagttcacctgttgaagataatctatgatcagccctatcttcccctaaatctaccctctacccctttcataggcagttaaggataaaagttgaggtacaaccacttacattctacctcatgaatacaacagagtttgctagaatgtttggcttgtgagtatggtggaaaccttgctctgtgccactctgagaagggcctcaggtactcataccaaccaaattaattattattacttcctttcatgatccttggctgtgtgactcacctttgctctgatctttgacttctagttcttatctcaggtcctgccattaaacaccttatttggtcatgtttatctgaactgaccctcagccctgtctttaggacagaactttatatttaatttcagcctctgtgtgcttttcaccttaacactgtattccccaggggagagttgaatcagccctatacagcattctggaagggaaaaggggattagaaagatatatctttcttgccattagattgaatcctaactcacttagcctctgcccctcactacctgtctgctgatggaagaagttttagaaggaaagagaaactgactgttaagaatcagattaacttatgactgtgcaatctttgcttagctaagttgcaatatatattctcttctctgttctattacctcctttcactttttctctcagaataaattcaaattaaggccatcctagatcaggcttttctgggagcagatcttgaaccaaggattggggtgcagatgattttattgaggacgtgttctccagagacaccatgaagggaataggcagcagaatagagaaggggaaaaacccagcccagctttggtggttttttttagtccaacttagagtataagccatacctcagaatttgagaatttgttccctactcagcaaaggggcaggttgtttgtgctcttacgccaattgttcctttaggagatccttgggaagagaagggcccagaagcagtagtgttaacctctgggcacttcccattttcctccataccaaaggccagtcttcagaggcaaagcaggcagatgttgggggagggccacacagaacttgtaaaagggaccttaaaagatctggaaaggcaccatgagtgttcagtgcttgtttctctagtctgaaaagtggaagccattttctaaaaccatgaaagaataatttttgctagggctctgtttccaatccaaaagaatcatgttttccaatcgctgatgtcaggattagacaaaaggtttgttgcctagaccctgatcaattcatacttaatactactgaatccttattatggtttaggtacaattttaaggctacaatatatattatctcttttaatcccatttaatttactcatcagtccagtatgatacgcattagtatgtggttgagctgggaagtctgacttcagggcctgtgtttccctacaaaaaaaaaaaaaaagcatggattctgcaaaattagaaaggagaaaatcatggctttcaggcccaatttctgcaaacaattctaaaaaaataatttaaaaaatcctgaactcagtggaataagaaccctaagcctgtcattaagctggattctaagatgtgtcagacatgactacatgcacagggtttatgaattggagctatcataatcagaatgtcatctccagtgctccgggatgcttttccctcctaagggaagatcttgttttctgactaggcttcagtactgagatagcgatcttcagaggtcccaagccttataaaggttatggtgcatcttcaatgtcagatttgaaataaaaacaataccaaactacaaatcaacataatgaggcctaacaattcttagaatgtactcaaaatgattacttctttcctcatttaaaatatatcaaaatctttcagaaatttattttttctcctgttttggcggggcagggagaggtcttccggatttctggtgtcttgtgtactagcagagtcttgactgttgaataatcatctccaccaccttcccttctcttgtcctcaccctcacccttcagtatactgtagtccttcctaatccaccattccacagtctcagttgattgcagtcagctgcatcctgaaaataggtgagcgcagtatattatgagagagagagagagagggactacaagcacacaactttcattacagtatattgttattggtataattattccattttattatgtttttgtttttaatctcttctgtgcataatttataaattaaactttatcgtatgtatatataggaaaatatatagtatgtatagagttcggtaccattcgaggtttcaagcatccactgagggacttggaaagtatcccccatggctaagtgggaactaccataaacacactctctctctgtctcgcgtgtgtgtgtgcacacacacacacactcacccaatgtcacctcaaaagttagtcacctttttcaccatgtagttcatagcatttattaatctcacatatcacacataaaaataatgttttctcttaggaataagggaatttattttctagaaatgagatttaaaagcacatagggttttctttcacccagttgcctttctttacaaataggaagaggcatgctttttttcccctttctgtgcgattgttctgtctgttgtatgatgctttttggtattgctacaatttctactgcaaactgaattttcctcctgttgctgctggtttatattgttctcccctgcagaattccttacctggtttacttccatcagcagcagtttgtgagtctcagatgatttgctgtttgtattaaactgtgagtttatatcaaagaagctgtgaattcattacgagaaggctgtgattctttcctgaaatttggtcttagttacctggcttgttcttcattattggttacttttcatttagaattgtatgatattaactgttttcttaagctactgccttaagtgctgctttagaacataatggaatataatactttaacaaaaaatgtatgcatgtaattatctttccattaaatttttttttccaaaatatctttcaaatgtggagtatacattctctccagcttttcattttaggtatgcttgttttgaagttaatgaattccttgagttttagataactattgacaaaacttttatatcagttctctttattaacttatcaagttaattctgaatcaatgctgtctagtaatactagaatgtaaaatgaagttgcattgtattttctctgagaattctcttctagaactgactttccaacatcaggagcaaatctattaaagtcacactatctttgtctttctaagccttagtttcccccaagtgctcagtgagaaataatataaaaggctcccttgtgctgtgtagactaatgacaaaaaattattggattaatgtttggaaagtgtttcagaattctctcaagaaagctattatgtaagtagcaagtactgttattattttgctatttcagcttccttatttttcatctctcaaagtcatttgggtcatttactacggaattttctgattccttgacaatttctaatggctctttggagaggcttttgagggctttttagtccccctgttgatgatctttctgcttatggagttcatgcttttttcacaacacattaatattcaggtttgaaaaaatagttgtagctatcttgtacctagatgaaattgcttatgttttggaggagaaatttatgatcttgcttttcaaataggattttttattttttgtagacttcctttgtggggtggtgaaaatggagctaggaatgccagttatgaatgataccctttggagaaaatgtaattgagcatggtccttaagtcatcctatgaaagcatccaaattctttatacctgtagttaggctatctttttgctctccagattagagtgaaaagttagcaatgctactttttgattacagagcatttgctatattcccatacatctattgtcaaaatttgtatttctcacaatccccaaaattgcggaatagaaagtgacaacatattttcttacttcctgcttatttcttctaagctcctgtgaataggaggtgggacgacaggctagttttttttttccataatattatatcatcatgaaaattctagagtgggagagaatgataaaactagtcattaggagtatattgctagttagtggcaaaattctatctgtacaatgatttagggtttcatttaggatttattttcatatggaactctactaaatatggtgccaagtaagtctgacagtttaacattttaccttcagaagtgaggaatatagaatgggaatatactcaagctcaagctttctcatcttggtagtttccctaaaaagtttttttttatctgactggacaatattaagtgctttagtttttaaaaaagcgagaagtactaagtctttattctgataattagcaattgcaaggaaataattacacattattctacatttactcttctgtattttactaagtatattttaaggtagacaaatagctccagttgatgagcactaatggagtgttcttgccacaaaataagttgattctgtatttaatcaagccatcagagctaacttccatttacaggaaaaatagaaaataaaaatataaacttaaataatattacaaaaagtataggtaaatccaaaaatgagccattctccacaataaatacaccaatttttgctgtaaagcaatgatgtggggaaaacaggtatcaggaacaagggcctgctttattttaaacaactaaatataataggtagatcttgtttgaattctgattcaagtaaaccaacagtaaaaaggacattttcacaatacatccagggaaatttgattatggagtgtaccttgggagatgacagtgagttattattaatgttttaggtgtaataatgacatcctaattgcctaggaaaaatgccatattcttaaaaaaggtatacactgaaatatgtaagagtgaaatgaaaggaggtctgagatttaaaatagatcatcaaaagtaaaaaatagccaaatcaaatggaacaaaatcttgatggttgtatggagaatcattacactttcttcttttctatattcaggataaaataatttttaagtgaggaaaagagcgtgtgcttgagaaggcatttcagatttccgattttttaatttgtataacaacagtgctgttgaattcttatccactgtcattactaattattttcatgaaaaactgatgagttggattatcttctttttcacttgggaacatctgatatgcatgataggtctctaattatctatctatctatctattatttacctatcttatctatctgtctatctatcatctatctatcttaacagttacattaacacttttaataaatttaaagcagcatgcacttagtagacgaaataagaaactgacaaacactccttttcttcacactctcacaggtttgttcttctgtctcttctctcatagctttgagtcttcatcgtttattctgggagaggccaggcattctcatccttgtgtactttggtacatattagtccctttgacaaaaatgcaatctcatttctcaataatgaaggacatttgtaatcatatttaaagcctcagtgcaaatactcgatcatctgtgaaactcaacttgattccttcagtctattttctcagtctccagtgctccttagaacagttgccttttctgtttttctgtatgttcatctccctgctgaatgatgagatgaccgaggacagggcaggtgcgccatctcttcatatttgtatcttcacttagcacagagcctcaaatatattagaaactctgtagatatttattgaatgagtgtgttaaggggagtctgttagtctaattgcatgtgggaagtcttaacactgagatggcttattgaaagaaatacttcctagtttctctcctctcagtcccccgggactgtgcttttggcatcttaggcagaagcactagaatttggctaattcagatgtctggggactggttttgcaggctttaaaattcatgcctctttttctcttaaaactcaacaactttgccttgaagtagaacatatttccattttttctattccattgcagccacctttttttctttcttccagttttacaacttccccagagcattacttccttccctgtggtcttcccaaaattcattttctgtttactgtttattgtaggactatattagtatggaacagattgtgaacttcatattatgtctcttgtcatccctgttatgtacacatcaaagacaaccttccctgaagctgtgtttggcatcttgggactctctctttgcagagtcaaagatctgagaccaatacctattcacagactatttccattgctgctgaactcctacagggaaaacagtggagaagtcttgaaacctatgggcgagttcttaaagctatcagtttcttgacctttctgccttattcttatttcccccaaatgtgctgtgtctttttgaaatgcaagcagaaggctcgatctcccttgggcagaagcagcaccttttgtgacttttctctctacttagattagtataagtcctctgttaacttgagaagctcaattccaatcatatgggctaactgaaaactcagaaaatctaaactttgagaactctgataatgactccttgcctcaattgatatttcaatgaattccacaactttgaggtgtttctttccttcatagagcaagaagagcagcataaaggttactcaaggaaagattcagaaccgtagatttgagtaaaaagccgtaaaaattacctaagaaactaccagaaagtggctcttaccttctcaagatcctcttaaatcaacctttggttgtgttctattacaaactaagagag
